(12) United States Patent
Stewart et al.

(10) Patent No.: US 11,866,724 B2
(45) Date of Patent: Jan. 9, 2024

(54) ADENOVIRAL VECTORS

(71) Applicant: Gene Bridges GMBH, Heidelberg (DE)

(72) Inventors: Adrian Francis Stewart, Dresden (DE); Jun Fu, Dresden (DE); Anja Ehrhardt, Witten (DE); Eric Ehrke-Schulz, Witten (DE); Wenli Zhang, Witten (DE)

(73) Assignee: Gene Bridges GMBH, Heidelberg (DE)

( * ) Notice: Subject to any disclaimer, the term of this patent is extended or adjusted under 35 U.S.C. 154(b) by 800 days.

(21) Appl. No.: 16/090,941

(22) PCT Filed: Apr. 6, 2017

(86) PCT No.: PCT/EP2017/058306
§ 371 (c)(1),
(2) Date: Oct. 3, 2018

(87) PCT Pub. No.: WO2017/174753
PCT Pub. Date: Oct. 12, 2017

(65) Prior Publication Data
US 2019/0382793 A1 Dec. 19, 2019

(30) Foreign Application Priority Data
Apr. 6, 2016 (GB) ...................................... 1605903

(51) Int. Cl.
| | | |
|---|---|---|
| C12N 15/86 | (2006.01) | |
| C12N 15/87 | (2006.01) | |
| C12N 7/00 | (2006.01) | |
| C12N 9/22 | (2006.01) | |
| C12N 15/11 | (2006.01) | |

(52) U.S. Cl.
CPC ............... *C12N 15/86* (2013.01); *C12N 7/00* (2013.01); *C12N 9/22* (2013.01); *C12N 15/11* (2013.01); *C12N 2310/20* (2017.05); *C12N 2710/10021* (2013.01); *C12N 2710/10043* (2013.01); *C12N 2800/80* (2013.01)

(58) Field of Classification Search
CPC . C12N 15/86; C12N 7/00; C12N 9/22; C12N 15/11
See application file for complete search history.

(56) References Cited

U.S. PATENT DOCUMENTS 6,140,087 A * 10/2000 Graham ............... C12N 15/86
435/320.1
2002/0102731 A1 8/2002 Hearing et al.
2006/0008884 A1 1/2006 Hearing et al.

FOREIGN PATENT DOCUMENTS

| WO | 2009104094 A2 | 8/2009 | |
|---|---|---|---|
| WO | WO-2011154927 A2 * | 12/2011 | ............. C12N 15/10 |
| WO | 2011154927 A3 | 2/2012 | |
| WO | 2012024351 A2 | 2/2012 | |

OTHER PUBLICATIONS

Zhang, Y., Buchholz, F., Muyrers, J. P., & Stewart, A. F. (1998). A new logic for DNA engineering using recombination in *Escherichia coli*. Nature genetics, 20(2), 123-128. (Year: 1998).*
Zhang, Y., Muyrers, J. P., Testa, G., & Stewart, A. F. (2000). DNA cloning by homologous recombination in *Escherichia coli*. Nature biotechnology, 18(12), 1314-1317. (Year: 2000).*
Muyrers JP, Zhang Y, Buchholz F, Stewart AF. RecE/RecT and Redα/Redβ initiate double-stranded break repair by specifically interacting with their respective partners. Genes & development. Aug. 1, 2000;14(15):1971-82. (Year: 2000).*
Chartier C, Degryse E, Gantzer M, Dieterle A, Pavirani A, Mehtali M. Efficient generation of recombinant adenovirus vectors by homologous recombination in *Escherichia coli*. J Virol. Jul. 1996;70(7):4805-10. doi: 10.1128/JVI.70.7.4805-4810.1996. PMID: 8676512; PMCID: PMC190422. (Year: 1996).*
Takahashi N, Yoshikura H, Kobayashi I. An *Escherichia coli* strain, BJ5183, that shows highly efficient conservative (two-progeny) DNA double-strand break repair of restriction breaks. Gene. Jan. 16, 2003;303:89-97. (Year: 2003).*
Lathe R, Vilotte JL, Clark AJ. Plasmid and bacteriophage vectors for excision of intact inserts. Gene. Jan. 1, 1987;57(2-3):193-201. ( Year: 1987).*
Sørensen HP, Mortensen KK. Advanced genetic strategies for recombinant protein expression in *Escherichia coli*. Journal of biotechnology. Jan. 26, 2005;115(2):113-28. (Year: 2005).*
Fu J, Bian X, Hu S, Wang H, Huang F, Seibert PM, Plaza A, Xia L, Müller R, Stewart AF, Zhang Y. Full-length RecE enhances linear-linear homologous recombination and facilitates direct cloning for bioprospecting. Nature biotechnology. May 2012;30(5):440-6. (Year: 2012).*
He TC, Zhou S, Da Costa LT, Yu J, Kinzler KW, Vogelstein B. A simplified system for generating recombinant adenoviruses. Proceedings of the National Academy of Sciences. Mar. 3, 1998;95(5):2509-14. (Year: 1998).*
O'Hanlon Cohrt, Karen. How to Manipulate Plasmid Copy Number Bite Size Bio: Jan. 14, 2015 (https://bitesizebio.com/profile/karenohanlon/) (Year: 2015).*
Boros I, Pósfai G, Venetianer P. High-copy-number derivatives of the plasmid cloning vector pBR322. Gene. Oct. 1, 1984;30(1-3): 257-60. (Year: 1984).*
Muyrers JP, Zhang Y, Stewart AF. Techniques: recombinogenic engineering-new options for cloning and manipulating DNA. Trends in biochemical sciences. May 1, 2001;26(5):325-31. (Year: 2001).*
Hanahan DO, Gluzman YA. Rescue of functional replication origins from embedded configurations in a plasmid carrying the adenovirus genome. Molecular and cellular biology. Feb. 1984;4(2):302-309. (Year: 1984).*

(Continued)

*Primary Examiner* — Quang Nguyen
(74) *Attorney, Agent, or Firm* — McNeill Baur PLLC

(57) ABSTRACT

The invention relates to adenoviral vectors, cells for use in generating adenoviral vectors, methods for generating adenoviral vectors, and therapeutic uses of adenoviral vectors in gene therapy, tumour therapy and as vaccines.

10 Claims, 27 Drawing Sheets

Specification includes a Sequence Listing.

(56) References Cited

OTHER PUBLICATIONS

GenBank (Gene ID: 945918) "recE Rac prophage; exonuclease VIII, ds DNA exonuclease, 5'→3' specific" and PubMed of internal references; retrieved online on Feb. 16, 2021 (Year: 2021).*
Alignment of amino acid sequence from Gene ID: 945918 with SEQ ID No. 1412 of U.S. Appl. No. 16/090,941 (Year: 2021).*
Danthinne et al.,"Production of first generation adenovirus vectors: a review," Gene Therapy, vol. 7, No. 20, pp. 1707-1714, Jan. 1, 2000.
International Search Report and Written Opinion of PCT/EP2017/058306, dated Sep. 14, 2017 (23 pages).
Aiuti et al., "Lentiviral hematopoietic stem cell gene therapy in patients with Wiskott-Aldrich syndrome," Science 341, 1233151, 14 pages, (2013).
Barnes et al., "Novel adenovirus-based vaccines induce broad and sustained T cell responses to HCV in man," Sci. Transl. Med. 4, 115ra1, 12 pages, (2012).
Barouch et al., "Novel adenovirus vector-based vaccines for HIV-1," Curr. Opin. HIV AIDS 5, pp. 386-390, 8 pages, (2010).
Biffi et al., "Lentiviral hematopoietic stem cell gene therapy benefits metachromatic leukodystrophy," Science 341, 1233158, 14 pages, (2013).
Bradley et al., "Adenovirus serotype 5 neutralizing antibodies target both hexon and fiber following vaccination and natural infection," J. Virol. 86, pp. 625-629, 5 pages, (2012).
Cheong, et al., "E1A-expressing adenoviral E3B mutants act synergistically with chemotherapeutics in immunocompetent tumor models," Cancer Gene Ther. 15, 20 pages, (2008).
Cody et al., "Armed replicating adenoviruses for cancer virotherapy," Cancer Gene Ther. 16, pp. 473-488, 30 pages, (2009).
Cong et al., "Multiplex Genome Engineering using CRISPR/Cas Systems," Science 15, 819-823, 7 pages, (2013).
Crystal, R., "Adenovirus: the first effective in vivo gene delivery vector," Human gene therapy 25, 3-11, 11 pages, (2014).
Davison et al., "Genetic content and evolution of adenoviruses," J. Gen. Virol. 84, 2895-2908, 15 pages, (2003).
Doronin et al., "Chemical modification with high molecular weight polyethylene glycol reduces transduction of hepatocytes and increases efficacy of intravenously delivered oncolytic adenoviruses," Hum. Gene Ther. 20, 975-988, 14 pages, (2009).
Gaggar et al., "CD46 is a cellular receptor for group B adenoviruses," Nat. Med. 9, 1408-1412, 5 pages, (2003).
Geisbert et al., "Recombinant adenovirus serotype 26 (Ad26) and Ad35 vaccine vectors bypass immunity to Ad5 and protect nonhuman primates against Ebolavirus challenge," J. Virol, 85, 4222-4233, 13 pages, (2011).
Ghebremedhin, B, "Human adenovirus: viral pathogen with increasing importance," Eur. J. Microbiol. Immunol. 4, 26-33, 9 pages, (2014).
Green et al., "Extended plasma circulation time and decreased toxicity of polymer-coated adenovirus," Gene Ther. 11, 1256-1263, 9 pages, (2004).
Hage et al., "Human Adenovirus type 70: A novel, multiple recombinant species D adenovirus isolated from diarrheal faeces of a haematopoietic stem cell transplantation recipient," J. Gen. Virol. 96, 2734-2742, 9 pages, (2015).
Hausl et al., "Development of Adenovirus Hybrid Vectors for Sleeping Beauty Transposition in Large Mammals," Curr. Gene Ther. 11, 363-374, 12 pages, (2011).
Kaufman et al., "Oncolytic viruses: a new class of immunotherapy drugs," Nature reviews. Drug discovery 14, 642-662, 22 pages, (2015).
Li et al., "PiggyBac transposase tools for genome engineering," Proc. Nat. Acad. Sci. USA 110, E2279-E2287, 9 pages, (2013).
Mashal et al., "Detection of mutations by cleavage of DNA heteroduplexes with bacteriophage resolvases," Nat. Genet. 9, 177-183, 7 pages, (1995).
Miralles et al., "The Adenovirus Inverted Terminal Repeat Functions as an Enhancer in a Cell-free System," The Journal of Biological Chemistry, vol. 264, No. 18, Issue of Jun. 25, pp. 10763-10772, 1989.
Nathwani et al., "Adenovirus-associated virus vector-mediated gene transfer in hemophilia B," The New England Journal of Medicine 365, 9 pages, (2011).
Kusano et al., "Plasmid-mediated Lethality and Plasmid Multimer Formation in an *Escherichia coli* recBC sbcBC Mutant Involvement of RecF Recombination Pathway Genes," J. Mol. Biol. (1989), 209 pp. 623-634 (12 pages).
Zabner et al., "Adenovirus-mediated gene transfer transiently corrects the chloride transport defect in nasal epithelia of patients with cystic fibrosis," Cell, vol. 75, 207-216 10 pages, (1993).
Penaloza-MacMaster, "Alternative serotype adenovirus vaccine vectors elicit memory T cells with enhanced anamnestic capacity compared to Ad5 vectors," J. Virol. 87, 1373-1384, 14 pages, (2013).
Rauschhuber et al., "RNAi suppressor P19 can be broadly exploited for enhanced adenovirus replication and microRNA knockdown experiments," Sci. rep. 3:1363, 7 pages, (2013).
Rodriguez et al., "Prostate attenuated replication competent adenovirus (ARCA) CN706: a selective cytotoxic for prostate-specific antigen-positive prostate cancer cells," Cancer Res. 57, 2559-2563, 6 pages, (1997).
Salzberg et al., "Microbial gene identification using interpolated Markov models," Nucleic Acids Research vol. 26, No. 2, pp. 544-548, 5 pages, (1998).
Search Report issued in Great Britain Application No. GB1605903.2, dated Feb. 28, 2017, (4 pages).
Slater et al., "Automated generation of heuristics for biological sequence comparison," BMC Bioinformatics 6:31, 11 pages, (2005).
Tuve et al., "A new group B adenovirus receptor is expressed at high levels on human stem and tumor cells," J. Virol. 80, No. 24, pp. 12109-12120, 13 pages, (2006).
Wang, et al., "Desmoglein 2 is a receptor for adenovirus serotypes 3, 7, 11 and 14," Nat. Med. vol. 17, No. 1, 96-105, 11 pages, (2011).
Wang, et al., "Improved seamless mutagenesis by recombineering using ccdB for counterselection.," Nucleic Acids Res. 42, e37, 12 pages, (2014).
Wikipedia, "Plasmid copy number," 3 pages. https://en.wikipedia.org/wiki/Plasmid_copy_number.
Wilson, J. M., "Gendicine: the first commercial gene therapy product," Human gene therapy 16, 1014-1015, 2 pages, (2005).
Wold et al., "Adenovirus vectors for gene therapy, vaccination and cancer gene therapy," Curr. Gene Ther. 13(6), 421-433 26 pages, (2013).
Yamamoto et al., "Current issues and future directions of oncolytic adenoviruses," Mol Ther. vol. 18, No. 2, 243-250, 8 pages, (2010).
Zhang et al., "Adenovirus receptors," J. Virol. 79, No. 19, 12125-12131, 7 pages, (2005).
Zhang et al., DNA cloning by homologous recombination in *Escherichia coli*, Nature biotechnology, 18(12), pp. 1314-1317 (2000).
Hofmayer et al., "Unique Sequence features of the Human Adenovirus 31 complete genomic sequence are conserved in clinical isolates," BMC Genomics, 10:557, Nov. 25, 2009 (14 pages).
Ginn et al., "Gene therapy clinical trials worldwide to 2012—an update," J Gene Med 2013; 15: 65-77 (13 pages).
Harrach, B. et al., "Virus Taxonomy: Classification and Nomenclature of Viruses," Adenoviradae, pp. 125-141 2011, (19 pages).
Jin et al., "Research Progress of Adenovirus and Its Vector," Journal of Tianjin Agriculture University, Jun. 2007, 14 (2): 48-51 (4 pages).
Li et al., "Construction of recombinant adenoviral vector by a simple, cheap, and high performance method," JTMU, 2005 11(2): 171-174 (4 pages).
Zhongbo et al., "A Method for Production and Manipulation of Recombinant Adenovirus Vector," J Huazhong Univ Sci Tech, vol. 32, No. 4, Aug. 2003 (4 pages).
English Translation of First Office Action issued in Chinese Application No. 20178003095.2, dated May 6, 2022 (23 pages).
Gao et al., "State-of-the-art human adenovirus vectorology for therapeutic approaches," FEBS Letters, 593, pp. 3609-3622, Dec. 2019 (14 pages).

(56) References Cited

OTHER PUBLICATIONS

Lu, Q., "Seamless cloning and gene fusion," Trends in Biotechnology, vol. 23, No. 4, pp. 199-207, Apr. 2005 (9 pages).

* cited by examiner

FIGURE 12
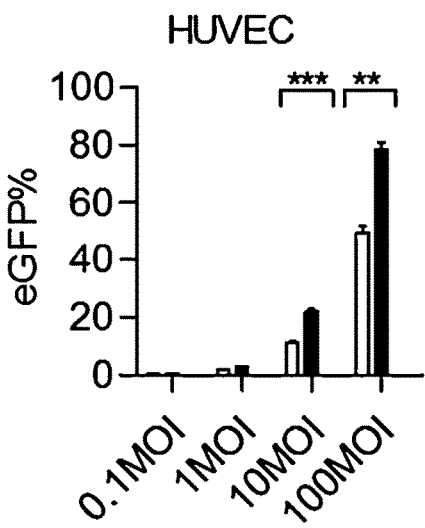
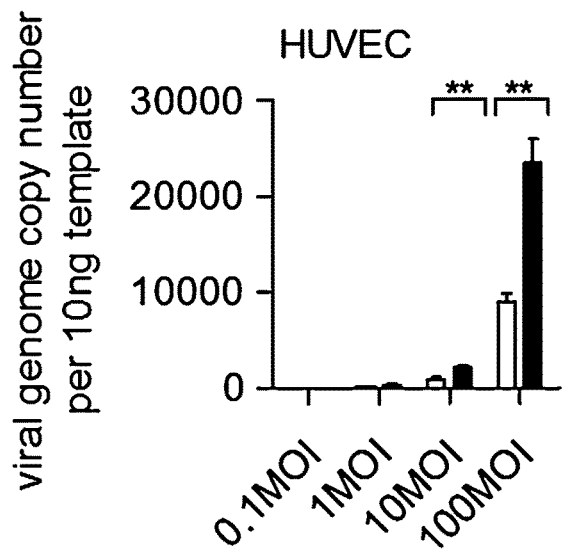
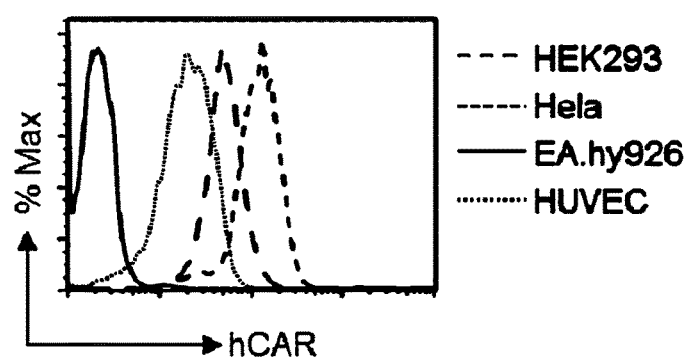
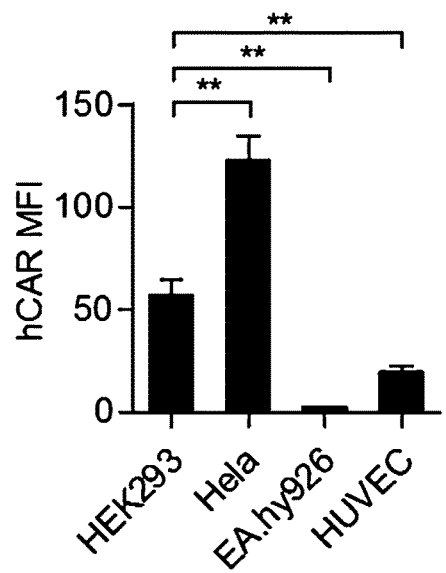

pHAdV17E1-IRES-neo

Methylene blue staining after G418 selection

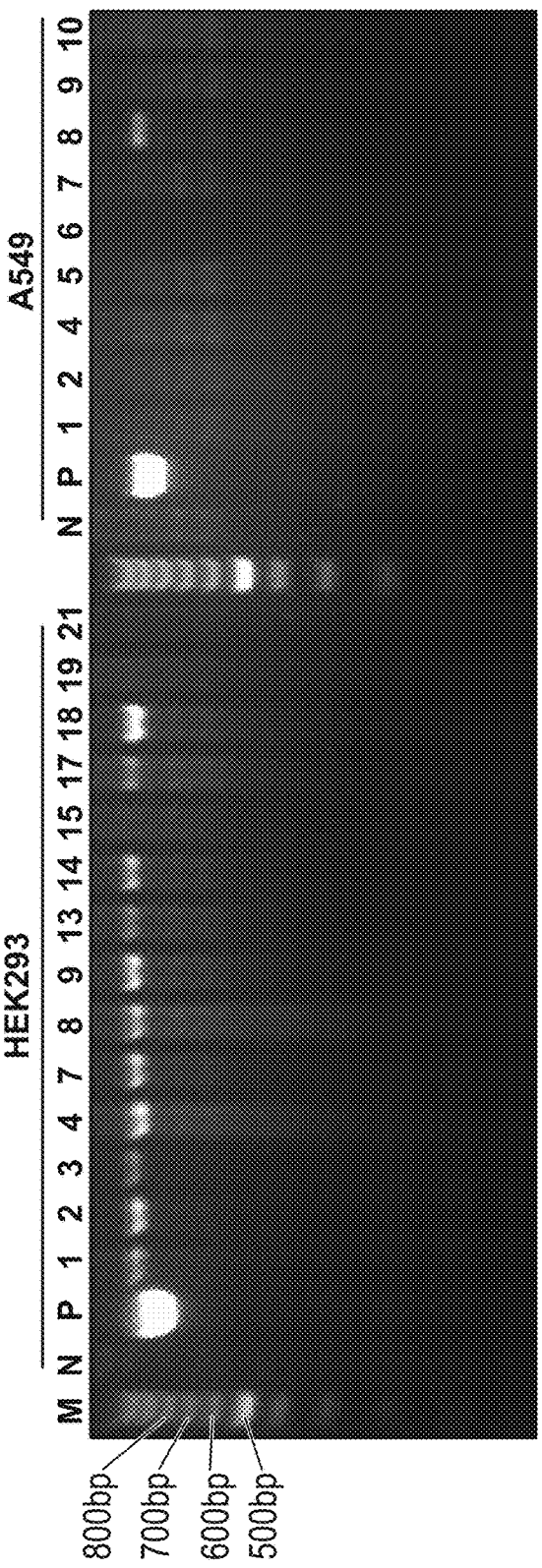
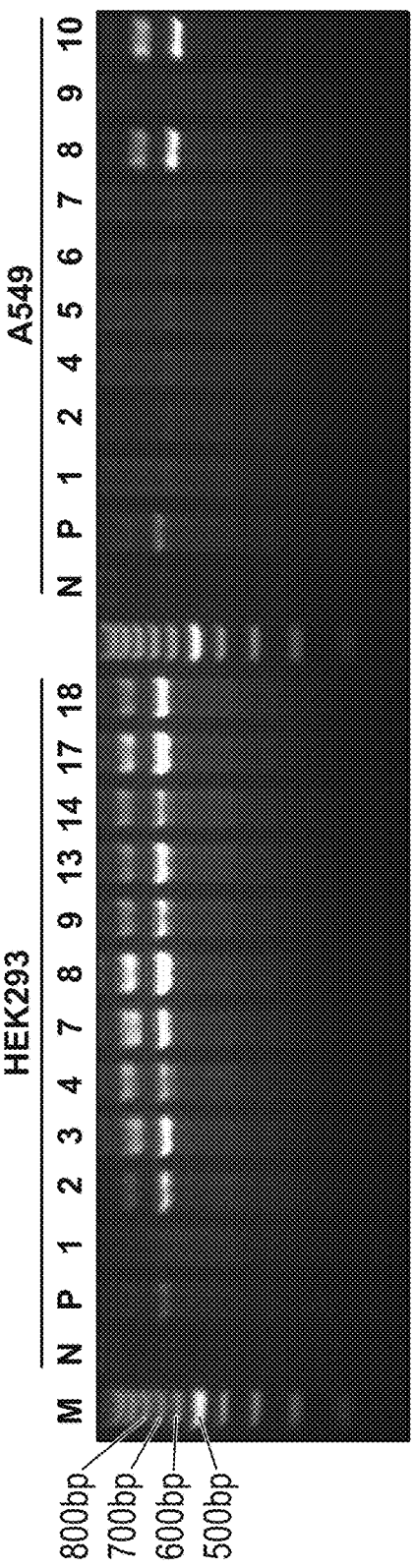
FIGURE 18C

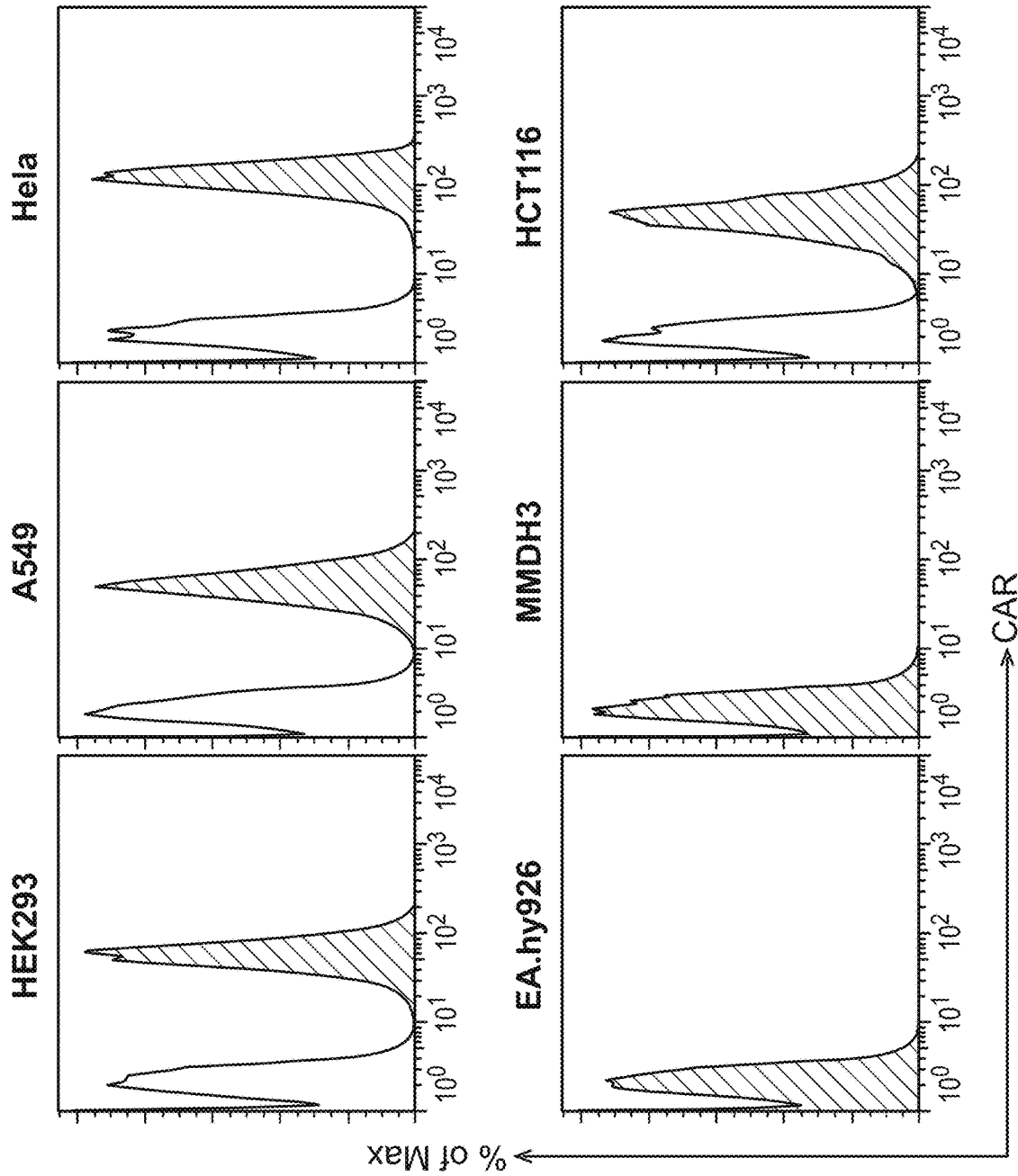

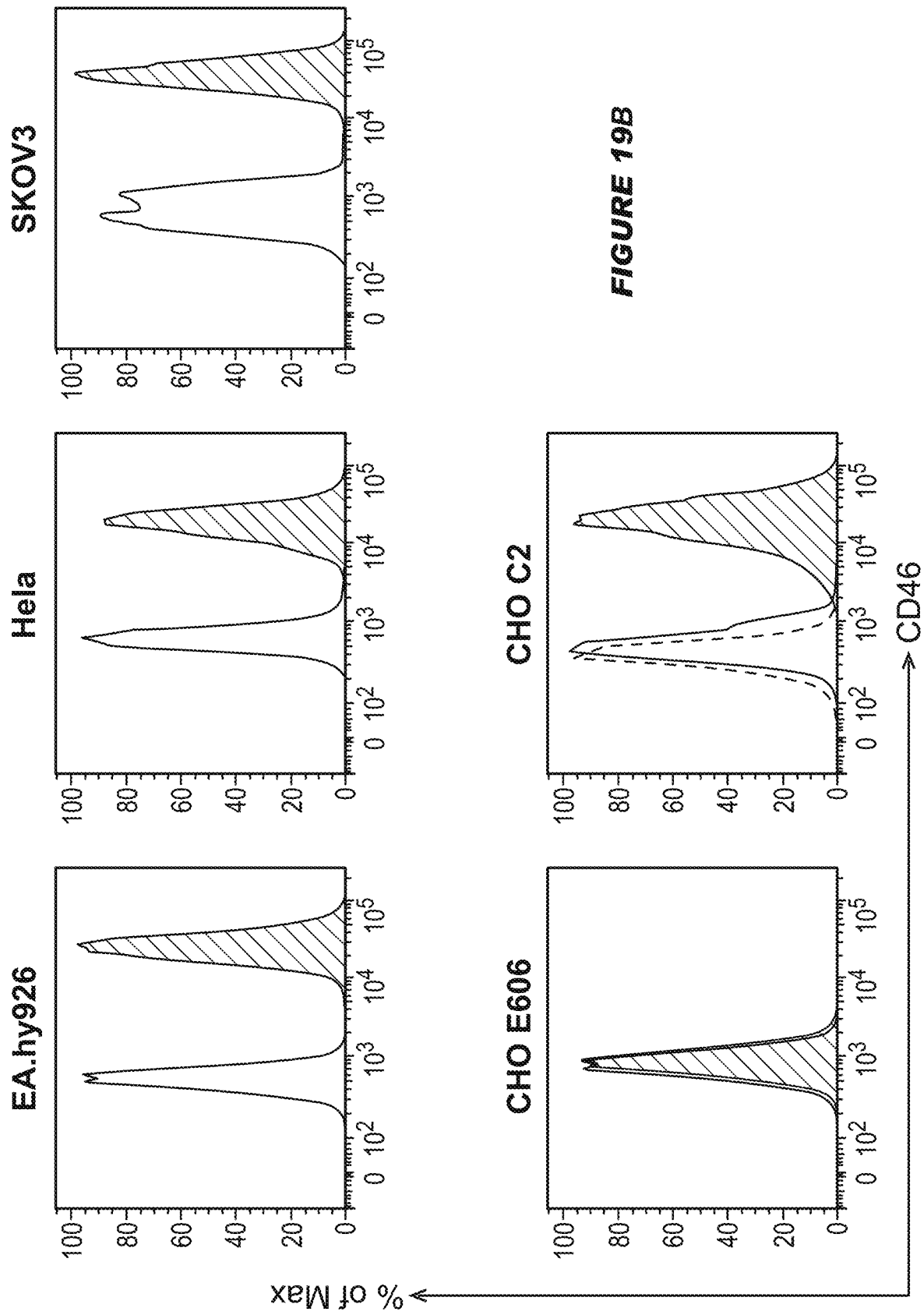

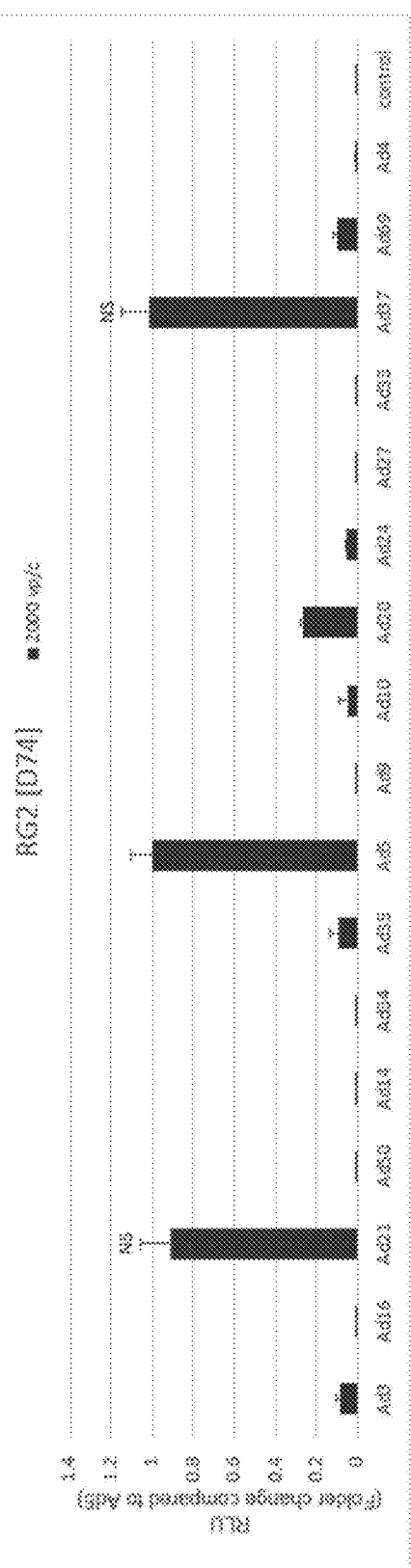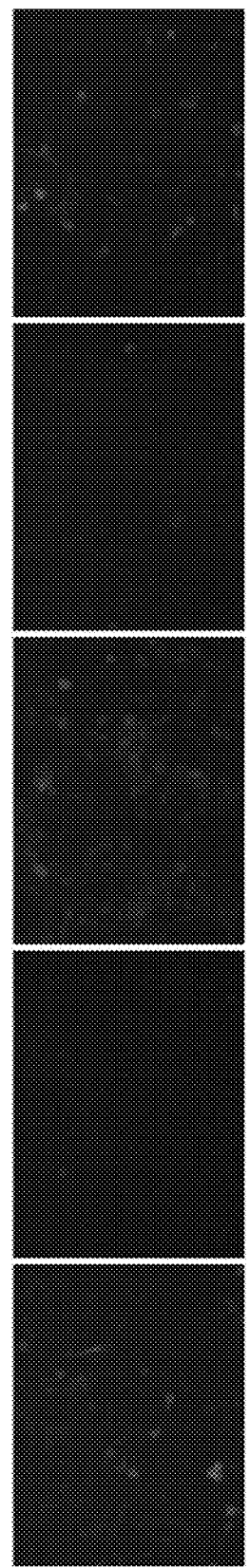
FIGURE 23

ADENOVIRAL VECTORS

CROSS-REFERENCE TO RELATED APPLICATIONS

This application is a national phase entry pursuant to 35U.S.C. § 371 of International Application No. PCT/EP2017/058306, filed Apr. 6, 2017, which claims the benefit of priority of Great Britain Application No. 1605903.2, filed Apr. 6, 2016, each of which is incorporated by reference herein in its entirety for any purpose.

SEQUENCE LISTING

The present application includes a Sequence Listing in electronic format. The Sequence Listing is provided as a file entitled "2021-12-03_01169-0014-00US_Seq_List_ST25.txt" created on Dec. 3, 2021, which is 3,576,078 bytes in size. The information in the electronic format of the sequence listing is incorporated herein by reference in its entirety.

FIELD OF THE INVENTION

The invention relates to adenoviral vectors, cells for use in generating adenoviral vectors, methods for generating adenoviral vectors, and therapeutic uses of adenoviral vectors in gene therapy, tumour therapy and as vaccines.

BACKGROUND TO THE INVENTION

Adenoviruses (Ad) are non-enveloped dsDNA viruses, typically 26-46 kb in length, flanked by inverted terminal repeats (ITR) at both ends. An increasing number of human and nonhuman Ad types are being identified. Besides the fact that adenoviruses are emerging pathogens in immunocompromised patients, they represent the most frequently used vector type for tumour therapy, gene therapeutic approaches and vaccination studies, largely owing to their robust gene delivery efficiencies and the ability to transduce a broad variety of cell types. However, exploration of the complete natural adenovirus diversity for broad applications has been absent because an efficient high throughput cloning (HTC) system has been lacking.

In recent years, adenoviruses have received increasing attention both as human and veterinary pathogens and as emerging therapeutics. As pathogens, adenoviruses cause a multitude of infections with growing numbers of fatalities. An effective treatment is lacking and lethality in immunocompromised patients amounts to 70%. As therapeutics, adenoviruses belong to the currently most promising candidates in the group of advanced-therapy medicinal products (ATMPs), with high potential for the treatment of malignant tumours as oncolytic viruses, as genetic vaccines against infectious diseases, and as gene transfer vectors for gene therapy applications. Increasing numbers of novel adenovirus types are being identified and it has become clear that adenoviruses comprise an enormous natural diversity of several hundred entities. However, most scientific knowledge on the virology of adenoviruses is based on a very small number of human type C adenoviruses, in particular human adenovirus 5 (HAdV-C5), despite the fact that the sequence diversity of the many adenovirus types is reflected in differences in their biology (e.g. tropism, infectious cycle, host interaction, persistence, immune evasion) and also in their virulence. Similarly, HAdV-C5 has served for many clinical tumour and gene therapy applications despite there being evidence that its therapeutic efficacy is strongly limited.

Gene therapy is an emerging field where therapeutic nucleic acids are delivered into target cells of interest. Recent success stories include the treatment of rare genetic diseases such as Wiskott-Aldrich syndrome[1], hemophilia B[2], and metachromatic leukodystrophy[3]. Adenovirus-based vectors represent the most frequently used vector types worldwide[4,5] for tumour therapy, gene therapeutic approaches, and vaccination studies, largely owing to their robust gene delivery properties and the ability to transduce a broad variety of cell types. First clinical trials utilising recombinant adenovirus for cystic fibrosis were initiated in 1993[6]. Adenoviral vectors gained global attention as a gene therapeutic agent when Gendicine was approved by the Chinese food and drug administration in 2003 for treatment of head and neck cancers[7]. Another option to treat malignancies is the use of tumour-specific replication competent adenoviruses for oncolytic virotherapy. In combination with chemotherapies and with further improvements, biologicals such as oncolytic viruses are being evaluated in clinical trials, which are likely to herald a growing repertoire of applications[8].

Although ~70 types of human Ad and numerous nonhuman Ad (>200) have been identified so far, a system for efficient Ad genome cloning and manipulation has been lacking. Previous studies have suggested using homologous recombination based techniques to clone adenoviral genomes into plasmids (Chartier, C. et al. (1996) *Efficient generation of recombinant adenovirus vectors by homologous recombination in Escherichia coli*. J. Virol. 70, 4805-4810; Renaut, L. et al. (2002) *A rapid and easy method for production and selection of recombinant adenovirus genomes*. J Virol Methods 100, 121-31). However, the homologous recombination in the bacterial strains used in these studies is highly inefficient, and these systems therefore require long homology arms and pure concentrated forms of adenoviral DNA. Accordingly, the majority of recombinant adenoviral vectors (AdVs) are still based on only a small fraction of Ad types and their variants[9,10,13]. However, predefined tissue tropism and pre-existing immunity considerably limit their applications. Limitations of vectors and oncolytic viruses based on HAd5 include cell tropism and pre-existing immunity in the human population against HAd5. HAd5 has a strong liver tropism in mice, as well as in humans when delivered intravenously, which is associated with a high innate immunity toxicity profile and sequestration of virus in the liver. The high seroprevalence of HAd5 in the human population results in induction of robust adaptive immune responses against vectors and oncolytic viruses based on this serotype, which hinder their effectiveness. Immune responses and liver sequestration of such vectors and viruses also mean that high doses are often administered to circumvent these problems, risking liver injury and inflammatory shock syndrome.

The present invention addresses the problems of pre-existing immunity and limited cell tropism of existing adenovirus vectors and oncolytic adenoviruses. By providing a novel engineered library of human adenoviral genomes, the inventors have facilitated the development of a vast repertoire of new adenoviral vectors and oncolytic viruses that can be used greatly to expand the range of possible applications, with the potential to improve therapeutic efficacy.

SUMMARY OF THE INVENTION

The present invention is based on the generation of a novel engineered full-genome, type-specific human adenovirus (HAdV) library made through novel recombineering technologies. This library provides the tools for arbitrary genetic modification of viral genomes and allows the generation of new adenoviral vectors, vaccines and oncolytic viruses, for example with improved efficacy and safety.

The inventors have established that adenoviral genomes can be high-throughput cloned (HTC) and tagged by using advanced linear-linear homologous recombination (LLHR) and linear-circular homologous recombination (LCHR) techniques[11,12]. Wild-type Ad from clinical isolates, including around half of the currently known adenovirus types, were propagated and direct high throughput cloning applied. The integrity of cloned Ad genomes was confirmed by DNA restriction pattern and virus reconstitution, and next-generation sequencing (NGS) and phylogenetic analysis was performed. The recombinant TurboGFP fluorescent/NanoLuc luciferase double reporter-marked AdVs facilitate vector characterisation and in vivo imaging. This new engineered adenoviral library will facilitate broader applications in molecular medicine including gene therapy and vaccination studies, as well as basic virology. The library of cloned genomes provided by the inventors facilitates generation of various vector types, genetic modification, insertion of transgenes, and tagging with reporter genes of adenoviruses of various different serotypes, using the methods disclosed herein. Such a system for straightforward manipulation of adenoviral genomes has been lacking.

The library provides for an improved scientific understanding of viral and host factors that determine the type-specific interactions of adenoviruses with their host, e.g. as regards tissue tropism, virus persistence, pathogenesis and virulence, and those factors essential to address potential risks associated with newly evolving adenoviruses. This library can also be used to screen for potential new drug targets for anti-adenoviral therapeutic strategies.

In one aspect, the invention provides adenoviral vectors with sequences derived from the newly-cloned adenoviral genomes in the library. Vectors comprising these novel sequences have various advantages of therapeutic potential, including altered cell tropisms relative to HAdV5-based vectors, so facilitating the targeting of different cell types, and/or the avoidance of pre-existing immunity against the HAdV5 serotype. For example, in one embodiment, the invention provides an adenoviral vector comprising a sequence derived from an adenoviral genome sequence contained within any one of SEQ ID Nos 1-32 and/or 1411, for example, contained within any one of SEQ ID Nos 1-15, 17-32 and/or 1411 or contained within any one of SEQ ID NOs: 1-3, 5-8, 10-12, 14-15, 17-25 and 27-32 and/or 1411, or contained within any one of SEQ ID NOs: 1-3, 5-8, 10-12, 14-15, 17-25 and 27-32, or a sequence at least 50% identical thereto. In another embodiment, the invention provides an adenoviral vector comprising the full adenoviral genome sequence contained within any one of SEQ ID Nos 1-32 and/or 1411, for example, contained within any one of SEQ ID Nos 1-15 and 17-32 and/or 1411 or contained within SEQ ID NOs: 1-3, 5-8, 10-12, 14-15, 17-25 and 27-32 and/or 1411, or contained within any one of SEQ ID NOs: 1-3, 5-8, 10-12, 14-15, 17-25 and 27-32, or a sequence at least 50% identical thereto. Preferably, the degree of sequence identity is at least 60%, 70%, 80%, 85%, 90%, 95%, 96%, 97%, 98%, 99%, 99.5% or 99.9%.

In another embodiment, the adenoviral vector lacks the E1 region. For example, in some embodiments, the invention provides an adenoviral vector comprising the adenoviral genome sequence contained within any one of the sequences listed in SEQ ID Nos 1-32 and/or 1411, for example, contained within any one of SEQ ID Nos 1-15 and 17-32 and/or 1411, or contained within any one of SEQ ID NOs: 1-3, 5-8, 10-12, 14-15, 17-25 and 27-32 and/or 1411, or a sequence at least 50% identical thereto, that lacks the E1 region. In one embodiment, the invention provides an adenoviral vector comprising a sequence selected from SEQ ID NOs: 1-3, 5-8, 10-12, 14-15, 17-25 and 27-32, or a sequence at least 50% identical thereto, that lacks the E1 region. Preferably, the degree of sequence identity is at least 60%, 70%, 80%, 85%, 90%, 95%, 96%, 97%, 98%, 99%, 99.5% or 99.9%.

In another embodiment, the adenoviral vector lacks the E1 region and the E3 region. For example, in some embodiments, the invention provides an adenoviral vector comprising the adenoviral genome sequence contained within any one of the sequences listed in SEQ ID Nos 1-32 and/or 1411, for example, contained within any one of SEQ ID Nos 1-15 and 17-32 and/or 1411 or contained within any one of SEQ ID NOs:1-8, 10-12, 14-15 and 17-32 and/or 1411, or a sequence at least 50% identical thereto, that lacks the E1 region and the E3 region. In another embodiment, the invention provides an adenoviral vector comprising a sequence selected from SEQ ID NOs:1-8, 10-12, 14-15 and 17-32, or a sequence at least 50% identical thereto, that lacks the E1 region and the E3 region. Preferably, the degree of sequence identity is at least 60%, 70%, 80%, 85%, 90%, 95%, 96%, 97%, 98%, 99%, 99.5% or 99.9%.

In another embodiment, the adenoviral vector lacks the E3 region. For example, in some embodiments, the invention provides an adenoviral vector comprising the adenoviral genome sequence contained within any one of the sequences listed in SEQ ID Nos 1-32 and/or 1411, for example, contained within any one of SEQ ID Nos 1-15 and 17-32 and/or 1411 or contained within any one of SEQ ID NOs: 1-3, 5-12, 14-15 and 17-32 and/or 1411, or a sequence at least 50% identical thereto, that lacks the E3 region. In another embodiment, the invention provides an adenoviral vector comprising a sequence selected from SEQ ID NOs: 1-3, 5-12, 14-15 and 17-32, or a sequence at least 50% identical thereto, that lacks the E3 region. Preferably, the degree of sequence identity is at least 60%, 70%, 80%, 85%, 90%, 95%, 96%, 97%, 98%, 99%, 99.5% or 99.9%.

In another embodiment, the invention provides a library of adenoviral vectors comprising at least 2 (for example, at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, or 33) of the adenovirus genome sequences described in SEQ ID NOs 1-32 and 1411, for example, of the adenovirus genome sequences described in SEQ ID NOs: 1-3, 5-8, 10-12, 14-15, 17-25 and 27-32 and/or 1411, and/or the other adenoviral vectors described herein. In some embodiments these adenoviral sequences are contained within a plasmid backbone.

In another embodiment, the invention provides an adenoviral vector comprising the 5' and 3' inverted terminal repeat (ITR) sequences from an adenoviral genome sequence disclosed herein. Preferably the 5' and 3' ITR regions are taken from the same adenoviral genome and are present at the 5' end and the 3' end, respectively, of the vector. Such vectors are used in conjunction with an adenovirus helper vector according to the invention. For example, in some embodiments, the invention provides an adenoviral vector comprising the 5' ITR sequence contained within any one of the sequences listed in SEQ ID Nos 1-32 and/or 1411, or a sequence at least 80% identical to the 5' ITR sequence, at the 5' end, and comprising the 3' ITR sequence contained within any one of the sequences listed in SEQ ID Nos 1-32 and/or 1411, or a sequence at least 80% identical to the 3' ITR sequence, at the 3' end. For example, in some embodiments, the invention provides an adenoviral vector comprising the 5' ITR sequence contained within any one of the sequences listed in SEQ ID Nos 1-15 and 17-32 and/or 1411 or contained within any one of SEQ ID NOs: 1-13 and 18-32 and/or 1411, or a sequence at least 80% identical to the 5' ITR sequence, at the 5' end, and comprising the 3' ITR sequence contained within any one of the sequences listed in SEQ ID Nos 1-15 and 17-32 and/or 1411 or contained within any one of SEQ ID NO: 1-13 and 18-32 and/or 1411, or a sequence at least 80% identical to the 3' ITR sequence, at the 3' end. For example, in some embodiments, the invention provides an adenoviral vector comprising a sequence selected from the sequences contained within any one of SEQ ID Nos 1-32 and/or 1411 at the positions defined in Table 1 column 4 or a sequence at least 80% identical thereto, at the 5' end, and at the positions defined in Table 1, column 5, or a sequence at least 80% identical thereto, at the 3' end. In some such embodiments, the invention provides an adenoviral vector comprising a sequence selected from the sequences contained within any one of SEQ ID Nos 1-15 and 17-32 and/or 1411 or contained within any one of SEQ ID NO: 1-13 and 18-32 and/or 1411 at the positions defined in Table 1, column 4 or a sequence at least 80% identical thereto, at the 5' end, and at the positions defined in Table 1, column 5, or a sequence at least 80% identical thereto, at the 3' end.

TABLE 1

Positions of inverted terminal repeats (ITRs) in genome sequences

| Adeno-virus | Genome SEQ ID NO | Positioning in genome sequence | | |
| --- | --- | --- | --- | --- |
| | | 5'ITR | 5'ITR + packaging signal | 3' ITR |
| A12 | 1 | 120-280 | 120-619 | 34095-34255 |
| A18 | 2 | 122-288 | 122-621 | 34088-34254 |
| A31 | 3 | 122-271 | 122-621 | 33777-33925 |
| B3 | 4 | 8-143 | 8-507 | 35214-35350 |
| B7 | 5 | 141-276 | 141-640 | 35210-35445 |
| B16 | 6 | 9-122 | 9-508 | 35418-35530 |
| B21 | 7 | 120-231 | 120-619 | 35423-35534 |
| B50 | 8 | 120-233 | 120-619 | 35392-35505 |
| B11 | 9 | 122-223 | 122-621 | 34816-35298 |
| B14a | 10 | 60-196 | 60-559 | 32328-32464 |
| B14b | 11 | 120-256 | 120-619 | 34747-34879 |
| B34 | 12 | 258-394 | 258-757 | 34896-35032 |
| B35 | 13 | 108-244 | 108-607 | 34761-34897 |
| C1 | 14 | 9-111 | 9-508 | 35906-36008 |
| C2 | 15 | 8-110 | 8-507 | 35842-35944 |
| C5 | 16 | 9-111 | 9-508 | 35840-35942 |
| C6 | 17 | 10-111 | 10-509 | 35667-35767 |
| D8 | 18 | 1-130 | 1-500 | 31390-31514 |
| D9 | 19 | 278-436 | 278-777 | 35044-35204 |
| D10 | 20 | 1-148 | 1-500 | 34938-35085 |
| D13 | 21 | 1-145 | 1-500 | 35062-35217 |
| D17 | 22 | 1-146 | 1-500 | 34998-35136 |
| D20 | 23 | 1-145 | 1-500 | 35031-35177 |
| D24 | 24 | 1-146 | 1-500 | 35580-35727 |
| D25 | 25 | 1-146 | 1-500 | 35105-35249 |
| D26 | 26 | 1-146 | 1-500 | 34987-35132 |
| D27 | 27 | 1-158 | 1-500 | 35000-35145 |
| D33 | 28 | 1-146 | 1-500 | 34966-35121 |
| D37 | 29 | 1-159 | 1-500 | 35056-35214 |
| D69 | 30 | 1-148 | 1-500 | 35001-35148 |
| E4 | 31 | 1-116 | 1-500 | 35877-35992 |
| G52 | 32 | 120-170 | 120-619 | 34885-34943 |
| F41 | 1411 | 1-155 | 1-500 | 34032-34189 |

In another embodiment, the invention provides an adenoviral vector comprising a sequence selected from SEQ ID NOs:33-45 and 50-64, or a sequence at least 80% identical thereto, at the 5' end, and a sequence selected from SEQ ID NOs:97-109 and 114-128, or a sequence at least 80% identical thereto, at the 3' end. Such vectors are used in conjunction with an adenovirus helper vector according to the invention. For example, in one embodiment, the invention provides an adenoviral vector comprising the sequence provided in Table 3, column 2 (headed "500 bp 5' UTR") of an adenovirus selected from B3, B16, C1, C2, C5, C6, D10, D13, D20, D24, D25, D26, D27, D33, D37, D69 and E4, or a sequence at least 80% identical thereto, at the 5' end, and comprising the sequence provided in Table 3, column 4 (headed "150 bp 3' ITR") of an adenovirus selected from B3, B16, C1, C2, C5, C6, D10, D13, D20, D24, D25, D26, D27, D33, D37, D69 and E4, or a sequence at least 80% identical thereto, at the 3' end. Preferably, the 5' and 3' sequences are derived from the same adenovirus.

In a further embodiment, the invention provides an adenoviral vector comprising a fiber gene from a genome sequence provided herein. For example, the invention provides an adenoviral vector comprising a fiber gene selected from any one of SEQ ID NOs 129-160 and 1443, for example, any one of SEQ ID NOs 129-160, or a sequence at least 70% identical thereto. In a further embodiment, the invention provides an adenoviral vector comprising a fiber gene selected from SEQ ID NOs:130-131, 135, 138-140, 142, 145-146, 149, 151, 153, 155 and 158-160, or a sequence at least 70% identical thereto. In some embodiments, the adenoviral vector does not contain any regions coding for adenoviral proteins other than these fiber proteins. The invention also provides adenoviral helper vectors with the same features.

The vector may further or alternatively comprise a penton gene selected from any one of SEQ ID NOs 161-192 and 1426, for example, any one of SEQ ID NOs: 161-192, for example selected from SEQ ID NOs:161-175 and 177-192, or a sequence at least 70% identical thereto, and/or a hexon gene selected from any one of SEQ ID NOs 193-224 and 1431, for example, any one of SEQ ID NOs:193-224, for example, selected from SEQ ID NOs:193-207 and 209-224, or a sequence at least 70% identical thereto.

The adenoviral vectors of the invention may be used as adenoviral vaccine vectors comprising a gene encoding an antigen, for example from human immunodeficiency virus (HIV), Ebolavirus, Zika virus, hepatitis B virus, hepatitis C virus, influenza virus, *Mycobacterium tuberculosis*, or *Plasmodium falciparum*.

The invention also provides an adenoviral helper vector comprising the adenoviral genome sequence contained within any one of SEQ ID NOs:1-32 and/or 1411, for example, contained within any one of SEQ ID NOs: 1-13 and 18-32 and 1411 or contained within any one of SEQ ID NOs: 1-13 and 18-32, or a sequence at least 50% identical thereto, that lacks the E1 region and comprises loxP sites (SEQ ID NO:221) or FRT sites (SEQ ID NO:222), wherein the loxP or FRT sites are positioned such that the first is downstream of the part of the sequence corresponding to the 5'ITR and upstream of the packaging signal (Table 1, column 4), and the second is upstream of the position of the deleted E1 region and downstream of the part of the sequence corresponding to the 5'ITR and packaging signal (Table 1, column 4).

The invention also provides an adenoviral helper vector comprising a sequence selected from SEQ ID NOs:1-13 and 18-32, or a sequence at least 50% identical thereto, that lacks the E1 region and comprises loxP sites (SEQ ID NO:221) or FRT sites (SEQ ID NO:222), wherein the loxP or FRT sites are positioned such that the first is downstream of the part of the sequence corresponding to SEQ ID NOs:65-77 and 82-96, respectively, and the second is upstream of the position of the deleted E1 region and downstream of the part of the sequence corresponding to SEQ ID NOs:33-45 and 50-64, respectively.

The invention also provides a cell encoding, and capable of expressing, an adenoviral E1 region contained within any one of SEQ ID Nos 1-32 and/or 1411, or a sequence at least 70% identical to said E1 region. In some embodiments, the invention provides a cell encoding, and capable of expressing, an adenoviral E1 region selected from within any one of SEQ ID NOs: 1-3, 5-8, 10-12, 14-15, 17-25, 27-32 and 1411, for example, selected from SEQ ID NOs: 1-3, 5-8, 10-12, 14-15, 17-25 or 27-32, or a sequence at least 70% identical to said E1 region. The cell may further express Cre recombinase or Flp recombinase. Such cells are used for producing adenovirus vectors according to the invention.

In another embodiment, the invention provides an oncolytic adenoviral vector comprising an E1 region selected from SEQ ID NOs 1-32 and 1411, for example, selected from SEQ ID NOs:1-8, 10-12, 14-15, 18-25, 27-32 or 1411, or for example selected from SEQ ID NOs:1-8, 10-12, 14-15, 18-25 or 27-32, or a sequence at least 70% identical to said E1 region. The oncolytic vector may further comprise:
a) an E2 region derived from SEQ ID NOs 1-32 and 1411, for example selected from SEQ ID NOs:1-8, 10-12, 14-15, 18-25, 27-32 or 1411, or for example selected from SEQ ID NOs:1-8, 10-12, 14-15, 18-25 or 27-32, or a sequence at least 70% identical to said E2 region;
b) an E4 region derived from SEQ ID NOs 1-32 and 1411, for example selected from SEQ ID NOs:1-8, 10-12, 14-15, 18-25, 27-32 or 1411, or for example selected from SEQ ID NOs:1-8, 10-12, 14-15, 18-25 or 27-32, or a sequence at least 70% identical to said E4 region;
c) an L1 region derived from SEQ ID NOs 1-32 and 1411, for example selected from SEQ ID NOs:1-8, 10-12, 14-15, 18-25, 27-32 or 1411, or for example selected from SEQ ID NOs:1-8, 10-12, 14-15, 18-25 or 27-32, or a sequence at least 70% identical to said L1 region;
d) an L2 region derived from SEQ ID NOs 1-32 and 1411, for example selected from SEQ ID NOs:1-8, 10-12, 14-15, 18-25, 27-32 or 1411, or for example selected from SEQ ID NOs:1-8, 10-12, 14-15, 18-25 or 27-32, or a sequence at least 70% identical to said L2 region;
e) an L3 region derived from SEQ ID NOs 1-32 and 1411, for example selected from SEQ ID NOs:1-8, 10-12, 14-15, 18-25, 27-32 or 1411, or for example selected from SEQ ID NOs:1-8, 10-12, 14-15, 18-25 or 27-32, or a sequence at least 70% identical to said L3 region;
f) an L4 region derived from SEQ ID NOs 1-32 and 1411, for example selected from SEQ ID NOs:1-8, 10-12, 14-15, 18-25, 27-32 or 1411, or for example selected from SEQ ID NOs:1-8, 10-12, 14-15, 18-25 or 27-32, or a sequence at least 70% identical to said L4 region; and
g) an L5 region derived from SEQ ID NOs 1-32 and 1411, for example selected from SEQ ID NOs:1-8, 10-12, 14-15, 18-25, 27-32 or 1411, or for example selected from SEQ ID NOs:1-8, 10-12, 14-15, 18-25 or 27-32, or a sequence at least 70% identical to said L5 region.

The E1 and/or E2 region of the oncolytic vector may be mutated or partially deleted to enhance replication activity and/or tumour specificity.

In embodiments in which the vectors comprise multiple different regions, these multiple regions may be derived from the same adenovirus genome or from different adenoviral genomes.

The oncolytic adenoviral vectors of the invention may further comprise:
a) a gene that enhances replication;
b) an immune-modulatory transgene;
c) a suicide gene or an interfering nucleic acid that enhances cell killing;
d) a gene or interfering nucleic acid that renders cells more sensitive to apoptosis or therapy with other drugs;
e) a tumour- or tissue-selective promoter; and/or
f) a gene for modulation of the tumour microenvironment.

The adenoviral vectors of the invention may be used in therapy. The invention also provides a method of treatment comprising administering an adenoviral vector of the invention to a patient. In some embodiments, the adenoviral vector comprises a transgene. In some embodiments, the invention comprises treating cancer comprising administering an adenoviral vector as described herein that is oncolytic for cells of the cancer.

The invention also provides a method of generating an adenoviral vector or helper vector, a cell, or an oncolytic adenoviral vector as defined above.

The invention further provides a method of inserting one or more transgenes into an adenoviral vector or helper vector or an oncolytic adenoviral vector according to the invention.

The invention also provides an adenoviral genome sequence selected from within any one of SEQ ID NOs 1-32 and 1411, for example, selected from within any one of SEQ ID NOs:1-3, 5-12, 14-15, 17-32 and 1411, or selected from within any one of SEQ ID NOs:1-3, 5-12, 14-15 and 17-32, comprising one or more reporter genes and means for their expression, replacing part or all of the E3 region. For example, the invention provides an adenoviral sequence selected from SEQ ID NOs:1-3, 5-12, 14-15 and 17-32, comprising one or more reporter genes and means for their expression, replacing part or all of the E3 region. Vectors comprising such sequences are also provided.

The invention also provides a method of screening for anti-adenoviral drugs, comprising:
a) infecting a cell with a vector comprising the adenoviral sequence within any one of the sequences selected from SEQ ID NOs: 1-3, 5-12, 14-15 and 17-32, comprising one or more reporter genes, and means for their expression, replacing part or all of the E3 region, in the presence and in the absence of a drug of interest;
b) detecting the expression level of the reporter gene product in the presence and in the absence of the drug; and
c) comparing the expression level of the reporter gene product in the presence and in the absence of the drug.

Definitions

In order to facilitate the understanding of the present description, the meaning of some terms and expressions in the context of the invention will be explained below. Further definitions will be included throughout the description as necessary.

"Sequence identity" as defined herein means sequence identity determined by the Smith-Waterman homology search algorithm as implemented in MPSRCH program (Oxford Molecular) using an affine gap search with parameters: gap penalty 10, gap extension penalty 0.5.

The term "high-capacity adenoviral vector" refers to an adenoviral vector that comprises only non-coding adenoviral sequences, and lacks all adenoviral coding regions.

"First generation adenoviral vector" refers to an adenoviral vector lacking the E1 and/or E3 regions.

An "adenoviral helper vector" is an adenoviral vector which provides the required early and late proteins necessary for replication, and is used in conjunction with high-capacity or "helper-dependent" vectors to allow their construction and propagation.

The term "transgene" refers to a gene or genetic material from a heterologous organism or virus. A transgene inserted into an adenoviral vector or oncolytic adenovirus will be a gene that is not derived from that particular adenovirus. The gene may be derived from any other organism or virus.

The term "expression cassette" (in relation to a transgene or antigen) refers to the transgene or antigen to be expressed, in conjunction with means for its expression (e.g. a promoter).

The term "antigen" in the present disclosure refers to an immunogenic protein that is not endogenous to the adenovirus of interest, i.e. it is encoded by a transgene derived from a heterologous organism or virus.

The term "immunomodulatory" refers to the inhibition or reduction of one or more biological activities of the immune system and includes, but is not limited to, downregulation of immune responses and inflammatory states as well as changes in cytokine profile, cytotoxic activity and antibody production.

The term "therapy" or "treatment" refers to treatment of a disease or disease pathology, and includes both therapeutic and prophylactic treatment. The term is not limited to curative treatment and covers any beneficial effect on disease processes (e.g. reducing the risk of, slowing, halting or reversing a disease process).

The term "about" refers to a range of ±10% of the stated value.

The term "comprising" encompasses "including" as well as "consisting" e.g. a composition "comprising" X may consist exclusively of X or may include something additional e.g. X+Y.

Where the invention refers to a sequence that has at least X % sequence identity with another sequence, in alternative embodiments, the invention further comprises sequences having a higher level of sequence identity with that sequence. For example, if a sequence is said to have at least 50% sequence identity with another sequence, then in alternative embodiments, a sequence having at least 55%, 60%, 65%, 70%, 75%, 80%, 85%, 90%, 95%, 97%, 98%, 99%, 99.5%, 99.8%, 99.9% is also provided.

When referring to the adenovirus type, this may be in the form of the species and number, e.g. adenovirus C5, or simply by "Ad" followed by the number, e.g. Ad5. These terms are used interchangeably and have the same meaning.

DETAILED DESCRIPTION OF THE INVENTION

The adenovirus library generated by the present inventors forms the basis for the generation of new adenovirus vectors, vaccines and oncolytic adenoviruses, as described below. In many cases, the novel sequences from the newly-cloned adenoviruses confer improved properties on the vectors and oncolytic viruses.

The sequences of the newly-cloned adenoviral genomes are given in the sequence listing. Table 2 summarises the SEQ ID NOs corresponding to each cloned genome.

TABLE 2

Cloned adenovirus genome sequences

| Adenovirus | SEQ ID NO |
|---|---|
| A12 | SEQ ID NO: 1 |
| A18 | SEQ ID NO: 2 |
| A31 | SEQ ID NO: 3 |
| B3 | SEQ ID NO: 4 |
| B7 | SEQ ID NO: 5 |
| B16 | SEQ ID NO: 6 |
| B21 | SEQ ID NO: 7 |
| B50 | SEQ ID NO: 8 |
| B11 | SEQ ID NO: 9 |
| B14a | SEQ ID NO: 10 |
| B14b | SEQ ID NO: 11 |
| B34 | SEQ ID NO: 12 |
| B35 | SEQ ID NO: 13 |
| C1 | SEQ ID NO: 14 |
| C2 | SEQ ID NO: 15 |
| C5 | SEQ ID NO: 16 |
| C6 | SEQ ID NO: 17 |
| D8 | SEQ ID NO: 18 |
| D9 | SEQ ID NO: 19 |
| D10 | SEQ ID NO: 20 |
| D13 | SEQ ID NO: 21 |
| D17 | SEQ ID NO: 22 |
| D20 | SEQ ID NO: 23 |
| D24 | SEQ ID NO: 24 |
| D25 | SEQ ID NO: 25 |
| D26 | SEQ ID NO: 26 |
| D27 | SEQ ID NO: 27 |
| D33 | SEQ ID NO: 28 |
| D37 | SEQ ID NO: 29 |
| D69 | SEQ ID NO: 30 |
| E4 | SEQ ID NO: 31 |
| G52 | SEQ ID NO: 32 |

In addition to the cloned adenoviruses recited in Table 1, SEQ ID NO: 1411 corresponds to the sequence of the newly-cloned F41 adenovirus genome. Sequence variants of the B11, D8 and D17 adenoviruses are contained within SEQ ID NOs 1413, 1414 and 1415 respectively. It will be understood that any embodiments of the invention related to SEQ ID NOs 9, 18 and 22 may also be extrapolated to encompass SEQ ID NOs 1413, 1414 and 1415 respectively, if required.

Sequences of individual transcription units and genes of particular importance from the novel cloned adenoviruses are also provided in the sequence listing. The SEQ ID NOs of these genes are set out in the tables below, together with an indication of the function of relevant genes. Any plasmid sequences contained at the 5' and/or 3'-ends of the genome sequences in SEQ ID Nos 1-32 and 1411 would be straightforward for a person skilled in the art to identify, as they would simply identify the ITRs of the adenovirus genomes, which are known in the art, and are known to define the ends of the adenovirus genome.

Non-Coding Regions for High-Capacity Adenoviral Vectors

Non-coding regions from the 5' and 3' untranslated regions of the adenoviral genomes are important in generating high-capacity adenoviral vectors of the invention (see below). High-capacity adenoviral vectors comprise 5' and 3' inverted terminal repeats (ITRs), which are included in high-capacity adenoviral vectors. These are found within around 150 bp of each end of the viral genome. The 5' region also comprises the packaging signal 4). This ensures that the DNA is packaged into virus particles. The packaging signal is found within 500 bp of the 5' end of the genome, downstream of the 5' ITR. The positions of the regions in SEQ IDs 1-32 and 1411 which contain the 5'ITR, the 5'ITR and the packaging signal, and the 3'ITR are shown in Table 1.

The sequences comprising the 500 bp and 150 bp of the 5'-end, and the 150 bp of the 3'-end of SEQ IDs 1-32 are shown in Table 3. Some of these sequences comprise plasmid sequence. However, the 150 bp 5'UTR and 150 bp 3'ITR SEQ ID NOs corresponding to the B3, B16, 01, C2, C5, C6, D10, D13, D20, D24, D25, D26, D27, D33, D37, D69 and E4 adenoviruses in Table 3 do comprise the 5'ITRs and the 3'ITRs, respectively as defined in Table 1.

TABLE 3 key non-coding regions

| Adenovirus | 500 bp 5' UTR | 150 bp 5' UTR | 150 bp 3' ITR |
|---|---|---|---|
| A12 | SEQ ID NO: 33 | SEQ ID NO: 65 | SEQ ID NO: 97 |
| A18 | SEQ ID NO: 34 | SEQ ID NO: 66 | SEQ ID NO: 98 |
| A31 | SEQ ID NO: 35 | SEQ ID NO: 67 | SEQ ID NO: 99 |
| B3 | SEQ ID NO: 36 | SEQ ID NO: 68 | SEQ ID NO: 100 |
| B7 | SEQ ID NO: 37 | SEQ ID NO: 69 | SEQ ID NO: 101 |
| B16 | SEQ ID NO: 38 | SEQ ID NO: 70 | SEQ ID NO: 102 |
| B21 | SEQ ID NO: 39 | SEQ ID NO: 71 | SEQ ID NO: 103 |
| B50 | SEQ ID NO: 40 | SEQ ID NO: 72 | SEQ ID NO: 104 |
| B11 | SEQ ID NO: 41 | SEQ ID NO: 73 | SEQ ID NO: 105 |
| B14a | SEQ ID NO: 42 | SEQ ID NO: 74 | SEQ ID NO: 106 |
| B14b | SEQ ID NO: 43 | SEQ ID NO: 75 | SEQ ID NO: 107 |
| B34 | SEQ ID NO: 44 | SEQ ID NO: 76 | SEQ ID NO: 108 |
| B35 | SEQ ID NO: 45 | SEQ ID NO: 77 | SEQ ID NO: 109 |
| C1 | SEQ ID NO: 46 | SEQ ID NO: 78 | SEQ ID NQ: 110 |
| C2 | SEQ ID NO: 47 | SEQ ID NO: 79 | SEQ ID NO: 111 |
| C5 | SEQ ID NO: 48 | SEQ ID NO: 80 | SEQ ID NO: 112 |
| C6 | SEQ ID NO: 49 | SEQ ID NO: 81 | SEQ ID NO: 113 |
| D8 | SEQ ID NO: 50 | SEQ ID NO: 82 | SEQ ID NO: 114 |
| D9 | SEQ ID NO: 51 | SEQ ID NO: 83 | SEQ ID NO: 115 |
| D10 | SEQ ID NO: 52 | SEQ ID NO: 84 | SEQ ID NO: 116 |
| D13 | SEQ ID NO: 53 | SEQ ID NO: 85 | SEQ ID NO: 117 |
| D17 | SEQ ID NO: 54 | SEQ ID NO: 86 | SEQ ID NO: 118 |
| D20 | SEQ ID NO: 55 | SEQ ID NO: 87 | SEQ ID NO: 119 |
| D24 | SEQ ID NO: 56 | SEQ ID NO: 88 | SEQ ID NO: 120 |
| D25 | SEQ ID NO: 57 | SEQ ID NO: 89 | SEQ ID NO: 121 |
| D26 | SEQ ID NO: 58 | SEQ ID NO: 90 | SEQ ID NO: 122 |
| D27 | SEQ ID NO: 59 | SEQ ID NO: 91 | SEQ ID NO: 123 |
| D33 | SEQ ID NO: 60 | SEQ ID NO: 92 | SEQ ID NO: 124 |
| D37 | SEQ ID NO: 61 | SEQ ID NO: 93 | SEQ ID NO: 125 |
| D69 | SEQ ID NO: 62 | SEQ ID NO: 94 | SEQ ID NO: 126 |
| E4 | SEQ ID NO: 63 | SEQ ID NO: 95 | SEQ ID NO: 127 |
| G52 | SEQ ID NO: 64 | SEQ ID NO: 96 | SEQ ID NO: 128 |

Late Transcription Units and Capsid Proteins

The late transcription units (L1-L5) encode structural proteins, which are responsible for virus tropism. The main structural proteins which form the viral capsid are hexon, penton base, and fiber. Fiber proteins protrude from the capsid surface and are primarily responsible for cell tropism, though other parts of the viral capsid (e.g. penton base) may contribute in some cases[17]. The fiber knob binds to receptors on the surface of certain cells in order to mediate cell attachment and the first step of cell entry. Penton base is involved in internalisation of virus particles via interaction with cellular integrins[13]. The hexon protein contains hyper-variable regions (HVRs) which are serotype-specific and are therefore considered to be major immune determinants. Most neutralising antibodies against HAd5 bind to the hexon HVR sequences, and to a lesser extent the fiber knob[14].

The capsid proteins are also responsible for the induction of host immune responses such as neutralising antibodies. Antigens at the surface of the virion are mainly type-specific[13]. Accordingly, constructing vectors or oncolytic viruses with one or more capsid proteins listed in Table 4 below may help to avoid the issues of pre-existing immunity encountered with HAdV5-based vectors and viruses, for example if the virus from which the capsid protein is derived has a lower seroprevalence in the human population than HAdV5. In addition to the capsid proteins in Table 4, SEQ ID NOs 1443, 1426 and 1431 correspond to the fiber, penton and hexon genes of the newly-cloned F41 adenovirus genome, respectively, and the invention similarly encompasses constructing vectors or oncolytic viruses with these sequences.

Where a vector includes the L1 region, this means that it comprises all of the open reading frames (ORFs) forming part of the L1 region, as well as any intervening sequences (coding or non-coding). The vector also includes any flanking sequence involved in expression of the L1 genes (e.g. starting from the upstream transcription start site). Analogous provisions apply to the L2, L3, L4 and L5 regions. ORFs from each of these regions, for each of the cloned viruses, are provided in Table 5.

TABLE 4 capsid proteins

| Adenovirus | Fiber | Penton | Hexon |
|---|---|---|---|
| A12 | SEQ ID NO: 129 | SEQ ID NO: 161 | SEQ ID NO: 189 |
| A18 | SEQ ID NO: 130 | SEQ ID NO: 162 | SEQ ID NO: 190 |
| A31 | SEQ ID NO: 131 | SEQ ID NO: 163 | SEQ ID NO: 191 |
| B3 | SEQ ID NO: 132 | SEQ ID NO: 164 | SEQ ID NO: 192 |
| B7 | SEQ ID NO: 133 | SEQ ID NO: 165 | SEQ ID NO: 193 |
| B16 | SEQ ID NO: 134 | SEQ ID NO: 166 | SEQ ID NO: 194 |
| B21 | SEQ ID NO: 135 | SEQ ID NO: 167 | SEQ ID NO: 195 |
| B50 | SEQ ID NO: 136 | SEQ ID NO: 168 | SEQ ID NO: 196 |
| B11 | SEQ ID NO: 137 | SEQ ID NO: 169 | SEQ ID NO: 197 |
| B14a | SEQ ID NO: 138 | SEQ ID NO: 170 | SEQ ID NO: 198 |
| B14b | SEQ ID NO: 139 | SEQ ID NO: 171 | SEQ ID NO: 199 |
| B34 | SEQ ID NO: 140 | SEQ ID NO: 172 | SEQ ID NO: 200 |
| B35 | SEQ ID NO: 141 | SEQ ID NO: 173 | SEQ ID NO: 201 |
| C1 | SEQ ID NO: 142 | SEQ ID NO: 174 | SEQ ID NO: 202 |
| C2 | SEQ ID NO: 143 | SEQ ID NO: 175 | SEQ ID NO: 203 |
| C5 | SEQ ID NO: 144 | — | SEQ ID NO: 204 |
| C6 | SEQ ID NO: 145 | — | SEQ ID NO: 205 |
| D8 | SEQ ID NO: 146 | SEQ ID NO: 176 | SEQ ID NO: 206 |
| D9 | SEQ ID NO: 147 | SEQ ID NO: 177 | SEQ ID NO: 207 |
| D10 | SEQ ID NO: 148 | SEQ ID NO: 178 | SEQ ID NO: 208 |
| D13 | SEQ ID NO: 149 | SEQ ID NO: 179 | SEQ ID NO: 209 |
| D17 | SEQ ID NO: 150 | SEQ ID NO: 180 | SEQ ID NO: 210 |
| D20 | SEQ ID NO: 151 | SEQ ID NO: 181 | SEQ ID NO: 211 |
| D24 | SEQ ID NO: 152 | SEQ ID NO: 182 | SEQ ID NO: 212 |
| D25 | SEQ ID NO: 153 | SEQ ID NO: 183 | SEQ ID NO: 213 |
| D26 | SEQ ID NO: 154 | SEQ ID NO: 184 | SEQ ID NO: 214 |
| D27 | SEQ ID NO: 155 | SEQ ID NO: 185 | SEQ ID NO: 215 |
| D33 | SEQ ID NO: 156 | SEQ ID NO: 186 | SEQ ID NO: 216 |
| D37 | SEQ ID NO: 157 | SEQ ID NO: 187 | SEQ ID NO: 217 |
| D69 | SEQ ID NO: 158 | SEQ ID NO: 188 | SEQ ID NO: 218 |
| E4 | SEQ ID NO: 159 | — | SEQ ID NO: 219 |
| G52 | SEQ ID NO: 160 | — | SEQ ID NO: 220 |

TABLE 5

ORFs in L1, L2, L3, L4 and L5 regions

| Adeno-virus | SEQ ID NOs | | | | |
|---|---|---|---|---|---|
| | L1 ORFs | L2 ORFs | L3 ORFs | L4 ORFs | L5 ORFs |
| A12 | 253-254 | 249-252 | 246-248 | 242-244 | 234 |
| A18 | 290-291 | 287-289 | 283-285 | 279-281 | 271 |
| A31 | 326-327 | 323-325 | 320-322 | 316-318 | 308 |
| B3 | 363-364 | 359-362 | 355-358 | 351-353 | 341 |
| B7 | 401-402 | 397-400 | 393-396 | 389-391 | 378 |
| B16 | 439-440 | 435-438 | 431-434 | 426-429 | 416 |
| B21 | 478-479 | 474-477 | 470-473 | 465-468 | 455 |
| B50 | 516-517 | 512-515 | 508-511 | 503-506 | 493 |
| B11 | 551, 553 | 548-550 | 545-547 | 541-543 | 531 |
| B14a | 587-588 | 583-586 | 580-582 | 576-578 | 571 |
| B14b | 627-628 | 623-626 | 620-622 | 616-618 | 606 |
| B34 | 664-665 | 661-663 | 658-660 | 654-656 | 644 |
| B35 | 701, 703 | 698-700 | 695-697 | 691-693 | 681 |
| C1 | 740-741 | 736, 738 | 733, 739 | 729, 734 | 720, 731 |

TABLE 5-continued

ORFs in L1, L2, L3, L4 and L5 regions

| Adeno-virus | SEQ ID NOs | | | | |
|---|---|---|---|---|---|
| | L1 ORFs | L2 ORFs | L3 ORFs | L4 ORFs | L5 ORFs |
| C2 | 778-779 | 774-777 | 771-773 | 768-769 | 760 |
| C5 | 816-817 | 812, 814 | 809-810 | 805 | 796, 807 |
| C6 | — | 850, 852 | 847-848 | 842 | 834 |
| D8 | 885-886 | 881-884 | 878-880 | 874-876 | 870 |
| D9 | 923-924 | 919-922 | 916-918 | 911-914 | 901 |
| D10 | 959-960 | 955-958 | 952-954 | 948-950 | 938 |
| D13 | 997-999 | 993-996 | 990-992 | 986-988 | 975 |
| D17 | 1035-1036 | 1030-1034 | 1027-1029 | 1022-1025 | 1013 |
| D20 | 1069-1070 | 1066-1068 | 1063-1065 | 1059-1061 | 1049 |
| D24 | 1105-1106 | 1101-1104 | 1098-1100 | 1094-1096 | 1084 |
| D25 | 1143-1145 | 1139-1142 | 1136-1138 | 1131-1134 | 1120 |
| D26 | 1181-1182 | 1178-1180 | 1175-1177 | 1170-1173 | 1160 |
| D27 | 1219-1220 | 1216-1218 | 1213-1215 | 1208-1211 | 1197 |
| D33 | 1257-1258 | 1253-1256 | 1250-1252 | 1245-1248 | 1234 |
| D37 | 1294-1295 | 1291-1293 | 1288-1290 | 1283-1286 | 1273 |
| D69 | 1330, 1332 | 1326-1329 | 1323-1325 | 1318-1321 | 1308 |
| E4 | 1368-1369 | 1364-1367 | 1360-1363 | 1356-1358 | 1346 |
| G52 | — | — | 1394-1395 | — | 1381-1382 |
| F41 | — | 1429 | 1431-1432 | — | — |

Cell Tropism

Most adenoviral vectors and oncolytic adenoviruses currently in use or development are based on HAdV5. One limitation of HAdV5-based vectors and viruses is the strong liver cell tropism of HAdV5 when administered intravenously.

The adenoviral genome sequences cloned by the present inventors provide a wide repertoire of sequences from which vectors and oncolytic viruses can be made, and many of these vectors and oncolytic viruses will have the advantage of a different cell tropism from HAdV5, based on the cell tropism of the virus from which the vector or oncolytic virus sequence is derived. If the vector or oncolytic virus is made as a hybrid of sequences from different viruses, its cell tropism will be determined by the tropism of the virus from which the capsid genes are derived (in particular the fiber shaft and knob).

For example, human adenovirus type 17 (HAdV17) shows endothelial cell tropism (see Example 3). Species B viruses demonstrate high transduction efficiencies in epithelial (HeLa and A549 cells) and endothelial cells, while Ad5 still displays the highest transduction rates in other human and murine cell types (hepatocytes, lymphocytes, neuroblastoma cells and myoblasts). Exploring natural adenovirus diversity revealed distinct tropisms in vivo (Example 1; FIG. 2)

Table 6 summarises the cell and/or tissue tropism of the cloned adenoviruses, any known cellular receptors for the cloned adenoviruses, and the types of infection caused by these adenoviruses. The tissue tropism and type of infection caused provide some guidance as to the likely cell tropism.

Table 6 also lists some possible therapeutic uses of vectors or oncolytic viruses derived from these adenoviral genomes, based on their tropism.

TABLE 6 tropism
Information adapted from references 15 and 16 (incorporated herein by reference).

| Ad | Cell tropism | Receptors | Tissue tropism | Type of infection | Possible therapeutic uses |
|---|---|---|---|---|---|
| A12 | | | Intestine | Gastrointestinal, respiratory, urinary | |
| A18 | | | Intestine | Gastrointestinal, respiratory, urinary | |
| A31 | | | Intestine | Gastrointestinal, respiratory, urinary | |
| B3 | Epithelial/ endothelial | DSG-2[17] | Tonsils/ respiratory tract | Keratoconjunctivitis, gastrointestinal, respiratory, urinary | Epithelial tumours |
| B16 | Epithelial/ endothelial | CD46[18] | Tonsils/ respiratory tract | Keratoconjunctivitis, gastrointestinal, respiratory, urinary | |
| B21 | Epithelial/ endothelial | CD46[18] | Tonsils/ respiratory tract | Keratoconjunctivitis, gastrointestinal, respiratory, urinary | |
| B50 | Epithelial/ endothelial | CD46[18] | Tonsils/ respiratory tract | Keratoconjunctivitis, gastrointestinal, respiratory, urinary | |
| B11 | Epithelial/ endothelial | CD46 DSG-2[17] | Hematopoietic cells, kidney, urinary bladder | Gastrointestinal, respiratory, urinary | Epithelial tumours |
| B14 | Epithelial/ endothelial | DSG-2[17] | Hematopoietic cells, kidney, urinary bladder | Gastrointestinal, respiratory, urinary | Epithelial tumours |
| B34 | Epithelial/ endothelial | | Hematopoietic cells, kidney, urinary bladder | Gastrointestinal, respiratory, urinary | |
| B35 | Epithelial/ endothelial | CD46[18] | Hematopoietic cells, kidney, urinary bladder | Gastrointestinal, respiratory, urinary | |
| C1 | | | Respiratory tract | Respiratory, gastrointestinal including hepatitis, urinary | |

TABLE 6-continued tropism
Information adapted from references 15 and 16 (incorporated herein by reference).

| Ad | Cell tropism | Receptors | Tissue tropism | Type of infection | Possible therapeutic uses |
|---|---|---|---|---|---|
| C5 | | | Respiratory tract (liver in mice) | Respiratory, gastrointestinal including hepatitis, urinary | |
| C6 | | | Respiratory tract | Respiratory, gastrointestinal including hepatitis, urinary | |
| D8 | | | Eye | Keratoconjunctivitis, gastrointestinal | |
| D9 | | | Eye | Keratoconjunctivitis, gastrointestinal | |
| D10 | | | Eye | Keratoconjunctivitis, gastrointestinal | |
| D13 | | | Eye | Keratoconjunctivitis, gastrointestinal | |
| D17 | Endothelial cells | hCAR CD46 | Eye | Keratoconjunctivitis, gastrointestinal | Endothelial disease or dysfunction, including coagulation disorders |
| D20 | | | Eye | Keratoconjunctivitis, gastrointestinal | |
| D24 | | | Eye | Keratoconjunctivitis, gastrointestinal | |
| D25 | | | Eye | Keratoconjunctivitis, gastrointestinal | |
| D26 | | | Eye | Keratoconjunctivitis, gastrointestinal | |
| D27 | | | Eye | Keratoconjunctivitis, gastrointestinal | |
| D33 | | | Eye | Keratoconjunctivitis, gastrointestinal | |
| D37 | | | Eye | Keratoconjunctivitis, gastrointestinal | |
| D69 | | | Eye | Keratoconjunctivitis, gastrointestinal | |
| E4 | | | Respiratory tract, eye | Keratoconjunctivitis, respiratory | | hCAR: human coxsackievirus and adenovirus receptor
DSG-2: desmoglein 2 is a calcium-binding transmembrane glycoprotein and forms part of the cadherin protein family.
DSG-2 is a component of the cell-cell adhesion structure in epithelial cells, and is overexpressed in various epithelial cancers, including gastric cancer, squamous cell carcinomas, melanoma, metastatic prostate cancer and bladder cancer[17].

Accordingly, the invention provides a method of infecting a cell with an adenoviral vector according to the invention wherein the cell is an epithelial cell or an endothelial cell. Also provided is a method of infecting a tissue with an adenoviral vector according to the invention wherein the tissue is selected from the intestine, tonsils, respiratory tract, hematopoietic cells, kidney, urinary bladder and eye. In some embodiments, the invention provides a method for treating one or more diseases recited in Table 4, for example, wherein the treatment comprises infecting the corresponding cell and/or tissue as recited in Table 4. For example, the invention provides a method of treating epithelial tumours comprising administering an adenoviral vector of the invention. Similarly, the invention provides a method of treating endothelial disease or dysfunction, for example a coagulation disorder, comprising administering an adenoviral vector of the invention. The invention further provides a method of treating a disease affecting the gastrointestinal, respiratory or urinary tract or the keratoconjunctiva or hepatitis infection comprising administering an adenoviral vector of the invention.

In some embodiments, the invention provides an oncolytic adenoviral vector, for use in treating osteosarcoma, wherein the oncolytic adenoviral vector is derived from the adenovirus B21. Similarly, the invention provides a method of treating osteosarcoma or glioblastoma comprising administering an oncolytic adenoviral vector derived from adenovirus B21 (B21 is the same as Ad21).

In other embodiments, the invention provides an oncolytic adenoviral vector, for use in treating lung carcinomas, wherein the oncolytic adenoviral vector is derived from the adenovirus B35 or D69. Similarly, the invention provides a method of treating a lung carcinoma comprising administering an oncolytic adenoviral vector derived from adenovirus B35 or D69.

Similarly, the invention provides a method of targeting human airway epithelial comprising administering an adenoviral vector derived from adenovirus B21, D37 or D69.

In some embodiments, the invention provides an adenoviral vector for use in infecting lung cells or tissue. In some embodiments, the adenoviral vector is derived from Ad21, Ad3, Ad37, or Ad69. In some embodiments, the adenoviral viral vector is for use in treating a disease of the lung, such as lung cancer or cystic fibrosis. Similarly, the invention provides a method of treating a disease of the lung comprising administering an adenoviral vector derived from adenovirus Ad21. In some embodiments, the adenoviral vector is oncolytic. In some embodiments the adenoviral vector comprises a transgene capable of treating the disease. In some embodiments, the adenoviral vector carries the CRISPR/Cas9 components and the treatment involves correcting the mutated gene sequence.

In one embodiment, the invention provides a method of transducing osteosarcoma cells or an osteosarcoma-derived cell line, comprising contacting the cells with a plasmid or adenoviral vector of the present invention, preferably wherein adenoviral sequences are derived from the adenovirus B21.

In another embodiment, the invention provides a method of transducing epithelial cells or an epithelial-derived cell line, comprising contacting the cells with a plasmid or adenoviral vector of the present invention, preferably wherein adenoviral sequences are derived from the adenovirus B3, B14, B16, B35 or B50.

In another embodiment, the invention provides a method of transducing endothelial cells or an endothelial-derived cell line, comprising contacting the cells with a plasmid or adenoviral vector of the present invention, preferably wherein adenoviral sequences are derived from the adenovirus B16 or B50.

In another embodiment, the invention provides a method of transducing breast cancer cells or a breast cancer-derived cell line, comprising contacting the cells with a plasmid or adenoviral vector of the present invention, preferably wherein adenoviral sequences are derived from the adenovirus D37. The invention also provides a method of treating breast cancer comprising administering an adenoviral vector derived from adenovirus D37. In some embodiments, the adenoviral vector is oncolytic. In some embodiments the adenoviral vector comprises a transgene capable of treating the disease.

In another embodiment, the invention provides a method of transducing liver cells or a liver-derived cell line, comprising contacting the cells with a plasmid or adenoviral vector of the present invention, preferably wherein adenoviral sequences are derived from the adenovirus C5, or B50.

In another embodiment, the invention provides a method of transducing lung cells or a lung-derived cell line, comprising contacting the cells with a plasmid or adenoviral vector of the present invention, preferably wherein adenoviral sequences are derived from the adenovirus Ad21, Ad37 or Ad69.

In one embodiment, the invention also provides adenoviral vectors of the invention for use in treating osteosarcoma, preferably wherein adenoviral sequences are derived from the adenovirus B21.

The invention provides a method of screening for cell tropisms, which comprises:
a) contacting a cell with an adenoviral vector as described herein; and
b) determining whether the vector infects the cell.

Similarly, the invention provides a method of screening for cell tropisms, which comprises:
a) contacting a cell with an adenoviral vector from a library of two or more adenoviral vectors as described herein;
b) determining whether the vector infects the cell; and
c) repeating steps a) and b) for at least one more member of the library (e.g. for at least 2, 3, 4, 5, 6, 7 or more) or each member of the library; and
d) optionally repeating steps a) to c) using a different cell type.

Advantageously, the vector may comprise a reporter gene which is a fluorescent protein or luciferase, and step b) may comprise determining whether the cell fluoresces or glows as a result of expression of the fluorescent protein or the luciferase. For example, step b) may comprise adding a luciferase substrate, such as furimazine or luciferin, and measuring the luminescence units.

In some embodiments, the method of screening for cell tropisms is carried out in vitro. In some embodiments, the method of screening for cell tropisms is carried out in vivo and comprises analysing the biodistribution as detected by transgene expression levels and/or viral genome level. For example, an in vivo method may be carried out in a mouse, rat, rabbit or guinea pig.

The invention further provides a method of screening for cell tropisms, which comprises:
a) contacting a cell with an adenoviral vector as described herein; and
b) determining whether the vector lyses the cell.

Similarly, the invention provides a method of screening for cell tropisms, which comprises:
a) contacting a cell with an adenoviral vector from a library of two or more adenoviral vectors as described herein;
b) determining whether the vector lyses the cell; and
c) repeating steps a) and b) for at least one more member of the library (e.g. for at least 2, 3, 4, 5, 6, 7 or more) or each member of the library; and
d) optionally repeating steps a) to c) using a different cell type.

In some embodiments, the step of determining whether the vector lyses the cells comprises staining the cells with crystal violet or methylene blue.

Advantageously, use of a method of screening for cell tropisms as described herein allows identification of a virus candidate for disease specific targeting. This allows development of novel therapeutic agents by carrying out further steps of modifying the virus using the methods described herein, e.g. so that it contains a transgene. Accordingly, the invention also provides a virus candidate for disease specific targeting identified by or identifiable by the method of screening for cell tropisms as described herein. Accordingly, the invention provides a method of treatment of a disease that affects a cell type comprising administering an adenoviral vector as described herein which has been identified (or can be identified) as infecting that cell type by a method of screening for cell tropisms as described herein, wherein the vector has been modified to incorporate one or more transgenes useful for treating the disease and/or wherein the vector is oncolytic for the cell type. In some embodiments, the one or more transgenes comprise a therapeutic agent. In some embodiments, the one or more transgenes is the CRISPR/Cas9 system.

The invention also provides a method of targeting a cell by contacting the cell with an adenoviral vector as described herein, wherein the type of cell has been identified (or can be identified) as a type of cell that is infected by the adenoviral vector using a method of screening for cell tropisms as described herein. In some embodiments, the vector has been modified to incorporate one or more transgenes. In some embodiments, the vector is oncolytic for the cell type. Thus, the method of targeting described herein provides a means to deliver a transgene of interest to a cell.

Early Transcription Units

The early transcription units are E1, E2, E3 and E4. E1, E2 and E4 are majorly involved in the replication cycle of adenoviruses.

The E1 transcription unit comprises E1A and E1B, and is the main unit responsible for initiating replication after cellular infection. E1A activates transcription of a number of viral genes as well as host cell genes. The protein coding genes of E1B have various functions, for instance suppressing apoptosis. The E1 region can be deleted in the vectors of the invention to make them replication deficient and consequently safer for use in therapy. Deletion of the E1 region (and optionally also other regions of the viral genome) also provides space to accommodate transgenes.

The E2 transcription unit encodes the DNA polymerase (Pol), the terminal protein (TP), and the DNA-binding protein (DBP) which are involved in replication and amplification of adenoviral DNA.

Products of the E4 transcription unit are involved in transcription, apoptosis, cell cycle control, DNA repair, cell signalling and posttranslational modifications.

The E3 transcription unit exhibits immunomodulatory functions: it protects cells from killing mediated by cytotoxic T cells and death-inducing cytokines, and can prevent apoptosis. This region varies significantly between the different adenovirus serotypes and can contain a different number of protein-coding genes.

Table 7 lists the open reading frames (ORFs) in the each of the early transcription units, for each of the cloned adenoviral genomes.

When reference is made to deletion of the E1 region, this means that minimally all the ORFs listed in Table 7 as forming part of the E1 region are deleted, and preferably also any intervening sequence, e.g. non-coding sequence or any further coding sequence. Some flanking sequence may also be deleted (e.g. the transcription start site).

Similarly, when reference is made to deletion of the E3 region, this means that minimally all the ORFs listed in Table 7 as forming part of the E3 region are deleted, and preferably also any intervening sequence, e.g. non-coding sequence or any further coding sequence. Some flanking sequence may also be deleted (e.g. the transcription start site).

Where a vector includes the E1 region, this means that it comprises all of the ORFs listed in Table 7 as forming part of the E1 region, including any intervening sequences (coding or non-coding). The vector also includes any flanking sequence involved in expression of the E1 genes (e.g. starting from the upstream transcription start site). Analogous provisions apply to the E2, E3 and E4 regions.

TABLE 7

ORFs in E1, E2, E3 and E4 regions

| Adeno-virus | SEQ ID NOs | | | |
|---|---|---|---|---|
| | E1 ORFs | E2 ORFs | E3 ORFs | E4 ORFs |
| A12 | 260-262 | 245, 256-257 | 236-241 | 229-233 |
| A18 | 296-299 | 282, 292-293 | 273-278 | 265-270 |
| A31 | 332-333 | 319, 329 | 310-315 | 302-307 |
| B3 | 369-372 | 354, 365-366 | 343-350 | 336-340 |
| B7 | 407-410 | 392, 403-404 | 380-388 | 373-377 |
| B16 | 445-449 | 430, 441-442 | 418-425 | 411-415 |
| B21 | 484-487 | 469, 480-481 | 457-464 | 450-454 |
| B50 | 522-525 | 507, 518-519 | 495-502 | 488-492 |
| B11 | 557-563 | 544, 552, 554-556 | 533-540 | 526-530 |
| B14a | 593-599 | 579, 589-590 | 573-575 | 566-570 |
| B14b | 633-637 | 619, 629-630 | 608-615 | 601-605 |
| B34 | 670-673 | 657, 666-668 | 646-653 | 639-643 |
| B35 | 707-711 | 694, 702, 704-706 | 683-690 | 676-680 |
| C1 | 749-752 | 730, 732, 743-745 | 721-728 | 714-718 |
| C2 | 785-788 | 770, 780, 782 | 761-767 | 754-758 |
| C5 | 823-826 | 806, 808, 818, 820 | 797-804 | 790-794 |
| C6 | 861-864 | 858 | 835-838, 840-841 | 828-832 |

TABLE 7-continued

ORFs in E1, E2, E3 and E4 regions

| Adeno-virus | SEQ ID NOs | | | |
|---|---|---|---|---|
| | E1 ORFs | E2 ORFs | E3 ORFs | E4 ORFs |
| D8 | 891-894 | 877, 888 | 872-873 | 865-869 |
| D9 | 929-931 | 915, 926 | 903-910 | 896-900 |
| D10 | 965-967 | 951, 962 | 940-947 | 933-937 |
| D13 | 1004-1007 | 989, 1001 | 977-985 | 969-974 |
| D17 | 1041-1043 | 1026, 1038 | 1015-1021 | 1008-1012 |
| D20 | 1075-1077 | 1062, 1072 | 1051-1058 | 1044-1048 |
| D24 | 1111-1113 | 1097, 1108 | 1086-1093 | 1079-1083 |
| D25 | 1150-1153 | 1135, 1147 | 1122-1130 | 1114-1119 |
| D26 | 1188-1190 | 1174, 1185 | 1162-1169 | 1154-1159 |
| D27 | 1225-1227 | 1212, 1222 | 1199-1207 | 1192-1196 |
| D33 | 1263-1265 | 1249, 1260 | 1236-1244 | 1229-1233 |
| D37 | 1300-1302 | 1287, 1296, 1297 | 1275-1282 | 1266-1272 |
| D69 | 1337-1339 | 1322, 1334 | 1310-1317 | 1303-1307 |
| E4 | 1374-1375 | 1359, 1370-1371 | 1348-1355 | 1340-1345 |
| G52 | 1407-1410 | — | 1384-1388 | 1376-1380 |
| F41 | 1416-1418 | 1421, 1423, — | 1436-1440- | 1444-1447- |

Adenoviral Vectors

Adenoviral vectors may be replication-deficient (RD) or replication-competent (RC). Vectors have certain regions of the adenoviral genome deleted to provide space for foreign DNA (e.g. transgenes). Replication-deficient adenoviral vectors are formed by deletion of the E1 region (which comprises the DA and E1B essential early genes) in the adenoviral genome, which ensures complete inhibition of viral replication in cells. Amplification of replication-deficient adenoviral vectors containing DNA of non-viral origin is feasible if essential viral components are provided in the helper cell in trans. This can be accomplished by generation of stable cell lines which complement for the lacking genes (see below).

Replication-competent adenoviral vectors usually lack the E3 region, as the E3 genes are not essential for Ad replication in cell culture or in vivo. Further details regarding RD and RC vectors may be found in reference 25, which is incorporated herein by reference.

As noted above, adenoviral cell and tissue tropism is determined primarily by the fiber capsid protein, in particular the stalk and knob regions of this protein. Other viral capsid proteins may also contribute to cell entry.

Accordingly, in one embodiment, the invention provides an adenoviral vector comprising a fiber gene selected from SEQ ID NOs:130-131, 135, 138-140, 142, 145-146, 149, 151, 153, 155 and 158-160, or a sequence at least 70% identical thereto.

Preferably, the sequence is at least 80%, 85%, 90%, 95%, 96%, 97%, 98%, 99%, 99.5% or 99.9% identical to a sequence selected from SEQ ID NOs:130-131, 135, 138-140, 142, 145-146, 149, 151, 153, 155 and 158-160.

The vector may further comprise a penton gene selected from SEQ ID NOs: 161-175 and 177-192, or a sequence at least 70% identical thereto. Preferably, the sequence is at least 80%, 85%, 90%, 95%, 96%, 97%, 98%, 99%, 99.5% or 99.9% identical to a sequence selected from SEQ ID NOs: 161-175 and 177-192.

The vector may further comprise a hexon gene selected from SEQ ID NOs:193-207 and 209-224, or a sequence at least 70% identical thereto. Preferably, the sequence is at least 80%, 85%, 90%, 95%, 96%, 97%, 98%, 99%, 99.5% or 99.9% identical to a sequence selected from SEQ ID NOs: 193-207 and 209-224.

The fiber, penton and hexon genes are preferably all derived from the same viral serotype (see Table 4).

Hybrid vectors may be constructed, comprising a fiber gene selected from SEQ ID NOs: 130-131, 135, 138-140, 142, 145-146, 149, 151, 153, 155 and 158-160 or a sequence at least 70% identical thereto, but comprising further viral sequences (coding and/or non-coding) from a different adenoviral serotype. The further viral sequences are from another adenoviral serotype forming part of the new library disclosed herein (selected from SEQ ID NOs:1-15 and 17-32), and preferably are not from human adenovirus 5 (Accession No. M73260). Adenoviral non-coding and coding sequences that can be incorporated into different types of vectors of the invention are discussed in further detail below.

This embodiment of the invention may be combined with any of the viral vector types described herein, including first generation vectors, including vaccine vectors. The vector according to this embodiment may also be a helper vector.

First Generation Adenoviral Vectors

The E1 region and/or the E3 region is deleted in first generation vectors of the invention. Deletion of such regions (and optionally also other regions of the viral genome) provides space to accommodate transgenes. Deletion of the E1 region makes the vectors replication deficient and consequently safer for use in therapy. Since the E1 gene products are required for viral growth, they are provided in trans in specific cell lines to allow production and amplification of the vectors. Vectors in which only the E3 region is deleted are replication competent.

Therefore, in one embodiment, the invention provides an adenoviral vector comprising a sequence selected from SEQ ID NOs:1-3, 5-8, 10-12, 14-15, 17-25 and 27-32, or a sequence at least 50% identical thereto, that lacks the E1 region.

Preferably, the sequence is at least 60%, 70%, 80%, 85%, 90%, 95%, 96%, 97%, 98%, 99%, 99.5% or 99.9% identical to a sequence selected from SEQ ID NOs:1-3, 5-8, 10-12, 14-15, 17-25 and 27-32.

In another embodiment, the invention provides an adenoviral vector comprising a sequence selected from SEQ ID NOs:1-8, 10-12, 14-15 and 17-32, or a sequence at least 50% identical thereto, that lacks the E1 region and the E3 region.

Preferably, the sequence is at least 60%, 70%, 80%, 85%, 90%, 95%, 96%, 97%, 98%, 99%, 99.5% or 99.9% identical to a sequence selected from SEQ ID NOs:1-8, 10-12, 14-15 and 17-32.

In a further embodiment, the invention provides an adenoviral vector comprising a sequence selected from SEQ ID NOs:1-3, 5-12, 14-15 and 17-32, or a sequence at least 50% identical thereto, that lacks the E3 region.

Preferably, the sequence is at least 60%, 70%, 80%, 85%, 90%, 95%, 96%, 97%, 98%, 99%, 99.5% or 99.9% identical to a sequence selected from SEQ ID NOs:1-3, 5-12, 14-15 and 17-32.

Hybrid vectors with a fiber protein from a different serotype can be constructed, as described above. Accordingly, the first-generation vectors may have the fiber gene replaced with a fiber gene from a different adenoviral serotype, selected from SEQ ID NOs:129-143 and 145-160, or a sequence at least 70% identical thereto (preferably at least 80%, 85%, 90%, 95%, 96%, 97%, 98%, 99%, 99.5% or 99.9% identical).

E1-deleted vectors can accept DNA insertions of up to around 5.1 kb. Vectors lacking both the E1 and the E3 regions can accommodate up to around 8.2 kb of foreign DNA[19]. Accordingly, a transgene (or one or more transgenes) inserted into the first generation adenoviral vectors of the invention may be up to around 5.1 kb in size in total if E1 is deleted, or up to around 8.2 kb in size in total if E1 and E3 are deleted.

It may be beneficial to retain the E3 region in some cases, as the E3 gene products include proteins which facilitate release of virus particles from cells and reduce cytotoxic T cell responses against cells transduced with the vector.

The above vectors can be used, for example, as helper vectors, oncolytic vectors, or vaccine vectors. Helper vectors should be replication deficient. Oncolytic vectors are replication competent. Vaccine vectors may be replication deficient, but are preferably replication competent as this may lead to the induction of better immune responses.

High-Capacity Adenoviral Vectors

High-capacity adenoviral vectors lack all viral coding sequences. The benefit of such vectors is that they can accommodate much larger transgenes, or multiple transgenes, than the first generation vectors in which only some coding sequences are deleted.

The only required sequences from the viral genome are cis-acting elements located at both ends of the adenoviral DNA molecule, which should include the packaging signal ($\psi$) located at the 5' end of the genome, and the inverted terminal repeats (ITRs) at both ends of the adenoviral genome. For the commonly used adenovirus type 5 the ITR is 103 bp in length and the packaging/enhancer sequences span nucleotides 194-458 bp located at the left arm of the adenoviral genome. In general, 500 bp at the 5' end of the genome will comprise the 5' ITR and the packaging signal, and 150 bp at the 3' end of the genome will comprise the 3' ITR.

Since high-capacity adenoviral vectors lack all viral coding regions, they are constructed and propagated in conjunction with an adenoviral helper vector, which provides the necessary viral functions (early and late proteins necessary for replication) in trans (see below). The high-capacity vectors can be separated from the helper vectors, for example by ultracentrifugation on cesium chloride density gradients and/or anion exchange and size exclusion chromatography.

High-capacity adenoviral vectors can accommodate up to around 37 kb of foreign genetic material (e.g. one large transgene, or more than one transgene), and they are therefore useful for carrying large transgenes or multiple transgenes (e.g. 2, 3, 4, 5 or more transgenes) and/or other heterologous DNA sequences.

Therefore, in one embodiment, the invention provides an adenoviral vector comprising a sequence selected from the sequences contained within SEQ ID NO: 1-13 and 18-32 at the positions defined in Table 1, column 4 or a sequence at least 80% identical thereto, at the 5' end, and the positions defined in Table 1, column 5, or a sequence at least 80% identical thereto, at the 3' end.

Preferably, the sequences are at least 85%, 90%, 95%, 96%, 97%, 98%, 99%, 99.5% or 99.9% identical to the sequences contained within SEQ ID NO: 1-13 and 18-32 at the positions defined in Table 1, column 4, and the positions defined in Table 1, column 5.

In one embodiment, the invention provides an adenoviral vector comprising a sequence selected from SEQ ID NOs: 33-45 and 50-64, or a sequence at least 80% identical thereto, at the 5' end, and a sequence selected from SEQ ID NOs:97-109 and 114-128, or a sequence at least 80% identical thereto, at the 3' end.

Preferably, the sequences are at least 85%, 90%, 95%, 96%, 97%, 98%, 99%, 99.5% or 99.9% identical to SEQ ID NOs:33-45, 50-64, 97-109 and 114-128.

HCAdV Applications—CRISPR/Cas9

Advantageously, gene deleted high-capacity adenoviral vectors (HCAdVs) of the invention may offer the ability to delivery one or more large genes to a cell of interest. For example, in some embodiments, a gene-deleted high-capacity adenoviral vector has a packing capacity of at least 15 kb, e.g. at least 20, 25, 30, 35, 40 or 45 kb. For example, in some embodiments, the gene-deleted high-capacity adenoviral vector comprises at least 15 kb, e.g. at least 20, 25, 30, 35, 40 or 45 kb, of DNA which is non-adenoviral genome sequence. The high-capacity adenoviral vectors of the invention may be used to deliver the components of the CRISPR/Cas9 system. The advantage of using the high-capacity adenovirus vectors for this purpose is that a single viral vector can be used, optionally with multiple guide RNAs. They may also be used to deliver transcription activator-like effector nucleases (TALENs) or zinc-finger nucleases (ZFNs). A useful application of these vectors is in vivo gene correction to treat genetic diseases. After cutting of the affected target locus in the host genome and in the presence of a respective donor DNA (which can be delivered by an adenoviral vector or an adeno-associated viral (AAV) vector), the mutated gene can be repaired by homology-directed DNA repair. In addition, such vectors can be used to treat infectious disease, for example as an antiviral approach to cut and destroy viral genomes. The invention provides these uses accordingly.

The clustered regularly interspaced short palindromic repeats (CRISPR)/Cas9 system allows for straightforward in vivo genome editing. Nevertheless, viral delivery of all required components including Cas9 and one or more guide RNA (gRNA) expression units using one single viral vector has not been fully exploited. Gene deleted high-capacity adenoviral vectors (HCAdVs) can efficiently deliver all expression units of the complete CRISPR/Cas9 machinery, including multiple gRNAs, into a broad variety of target cells using a single viral vector. However, the complicated handling of large DNA constructs and the time consuming production procedure hampered the use of HCAdV to deliver the CRISPR/Cas9 machinery for genome editing approaches. The present inventors have provided a toolbox for HCAdV genome manipulation for the fast and simple introduction of the customized CRISPR/Cas9 machinery to provide new instruments to improve somatic genome editing approaches in mammalian cells.

The inventors generated a new CRISPR/Cas9 shuttle plasmid toolbox containing the Cas9 nuclease gene, either utilising a constitutive or an inducible promoter, and a gRNA expression unit enabling customisation of the CRISPR/Cas9 for a desired target sequence. This allows cloning or recombining of all CRISPR/Cas9 components into the HCAdV genome in one step. To use several gRNA expression units for multiplexing the CRISPR/Cas9 system, further gRNA expression units can be easily included. Insertion of the CRISPR/Cas9 machinery can be either performed by recombineering[20] or conventional cloning. Further details regarding the CRISPR/Cas9 system, including the Cas9 gene and design of gRNAs, can be found in reference 21 (incorporated herein by reference).

Therefore, in one embodiment, the invention provides a plasmid which shares at least two regions of sequence homology with an adenoviral sequence of interest and which comprises the Cas9 gene and a guide RNA expression unit. In some embodiments, the Cas9 gene is under control of a constitutive promoter. In some embodiments, the Cas9 gene is under control of an inducible promoter. The regions of sequence homology may be designed to allow the Cas9 gene to be inserted into a chosen location in the adenoviral sequence. For example, in some embodiments, the at least two regions of sequence homology are designed so that the Cas9 gene and the gRNA expression unit are inserted into the E3 region of the adenoviral sequence. In some embodiments, the plasmid is the pAdV-FTC plasmid. Such a plasmid may be used in the methods of inserting one or more transgenes described herein as the second nucleic acid molecule.

Therefore, in one embodiment, the invention provides an adenoviral vector comprising a sequence selected from the sequences contained within SEQ ID NO: 1-13 and 18-32 at the positions defined in Table 1, column 4 or a sequence at least 80% identical thereto, at the 5' end, and the positions defined in Table 1, column 5, or a sequence at least 80% identical thereto, at the 3' end, and further comprising a Cas9 gene and at least one guide RNA. Preferably, the degree of sequence identity is at least 85%, 90%, 95%, 96%, 97%, 98%, 99%, 99.5% or 99.9%.

In one embodiment, the invention provides an adenoviral vector comprising a sequence selected from SEQ ID NOs: 33-45 and 50-64, or a sequence at least 80% identical thereto, at the 5' end, and a sequence selected from SEQ ID NOs:97-109 and 114-128, or a sequence at least 80% identical thereto, at the 3' end, and further comprising a Cas9 gene and at least one guide RNA.

Preferably, the degree of sequence identity is at least 85%, 90%, 95%, 96%, 97%, 98%, 99%, 99.5% or 99.9%.

The vector may comprise more than one guide RNA, for example two, three, four, five, eight, 10, 15, 20, 25, 30, 40, 50 or more guide RNAs.

The Cas9 gene may be expressed under the control of a constitutive or an inducible promoter.

In one embodiment, the invention provides an adenoviral vector as described herein, further comprising a gene encoding a transcription activator-like effector nuclease (TALEN) or a zinc-finger nuclease.

In some embodiments, the adenoviral vectors disclosed herein comprise at least 1 kb of non-adenoviral sequence, e.g. at least 2, 5, 10, 15, 20, 25, 30, 35 or 40 kb non-adenoviral sequence. In some embodiments, the non-adenoviral sequence encodes one or more transgenes of interest. In some embodiments, the non-adenoviral sequence is not plasmid sequence.

HCAdV Applications—Transposons

The high-capacity adenoviral vectors of the invention may be utilised in conjunction with the Sleeping Beauty transposon system, or other transposon systems such as PiggyBAC[22], to facilitate stable modification of transduced target cells. Any cell type, including stem cells, can be modified by the adenovirus-Sleeping Beauty hybrid vector system[23].

Accordingly, in one embodiment, the invention provides an adenoviral vector comprising a sequence selected from the sequences contained within SEQ ID NO: 1-13 and 18-32 at the positions defined in Table 1, column 4 or a sequence at least 80% identical thereto, at the 5' end, and the positions defined in Table 1, column 5, or a sequence at least 80% identical thereto, at the 3' end, and further comprising a Sleeping Beauty transposase gene (SEQ ID NO:223) and a transgene flanked by the inverted repeats of the Sleeping Beauty transposon (SEQ ID NOs:224 and 225), or comprising a PIGGYBac transposase gene (SEQ ID NO:226) and a transgene flanked by the inverted repeats of the PIGGYBac transposon.

Preferably, the sequences are at least 85%, 90%, 95%, 96%, 97%, 98%, 99%, 99.5% or 99.9% identical to the sequences contained within SEQ ID NO: 1-13 and 18-32 at the positions defined in Table 1, column 4, and the positions defined in Table 1, column 5.

In one embodiment, the invention provides an adenoviral vector comprising a sequence selected from SEQ ID NOs: 33-45 and 50-64, or a sequence at least 80% identical thereto, at the 5' end, and a sequence selected from SEQ ID NOs:97-109 and 114-128, or a sequence at least 80% identical thereto, at the 3' end, and further comprising a Sleeping Beauty transposase gene (SEQ ID NO:223) and a transgene flanked by the inverted repeats of the Sleeping Beauty transposon (SEQ ID NOs:224 and 225), or comprising a PIGGYBac transposase gene (SEQ ID NO:226) and a transgene flanked by the inverted repeats of the PIGGYBac transposon.

Preferably, the sequences are at least 85%, 90%, 95%, 96%, 97%, 98%, 99%, 99.5% or 99.9% identical to SEQ ID NOs:33-45, 50-64, 97-109 and 114-128.

In preferred embodiments, the transposase is expressed under the control of an inducible promoter. It is particularly preferred that this should be a cell-specific promoter, permitting expression of the transgene only in target cells of interest.

The adenovirus-Sleeping Beauty or adenovirus-PiggyBac hybrid vectors of the invention can be used to stably integrate transgenes into stem cells, e.g. hematopoietic stem cells. The main advantage of this strategy is that it avoids the sophisticated ex vivo transduction procedure usually required to transform hematopoietic stem cells. Instead, these stem cells can be directly transduced in vivo after mobilisation form the bone marrow and subsequent systemic administration of the hybrid vectors. Transgenes that can be stably integrated into these stem cells include those encoding coagulation factor VIII, coagulation factor IX, von Willebrand factor, haemoglobin, and other genes involved in genetic disorders derived from HSCs.

Transgenes for Inclusion in Adenoviral Vectors

The adenoviral vectors of the invention may include any transgene (or more than one transgene). Transgenes with therapeutic utility are preferred.

Transgenes of particular interest in human gene therapy are listed below by way of example, but other transgenes may also be included in the adenoviral vectors of the invention.

Von Willebrand disease (VWD)—the large transgene encoding von Willebrand factor (vWF; Accession No. FLJ75522) cannot be delivered by e.g. adeno-associated virus vectors due to its size. The adenovirus vectors of the present invention can be used to achieve endothelial cell-specific vWF expression (endothelial cells are the natural producer cell type of vWF). For example, vectors based on HAdV D17, which have an endothelial cell tropism, can be used for endothelial cell-specific vWF expression.

Coagulation factor VIII (FVIII) deficiency/haemophilia A—the large transgene encoding FVIII (Accession No. NM_000132) can be delivered using the high-capacity adenoviral vectors of the invention. The transgene can be subsequently mobilised for somatic integration into the host genome using the high-capacity adenovirus/Sleeping Beauty hybrid vectors.

Beta-thalassemia—the haemoglobin gene (Accession No. NC_000023) can be included in the adenovirus vectors of the invention to treat the haemoglobin deficiency that causes beta-thalassemia.

Muscular dystrophy—Dystrophin gene (DMD) (Accession No. NC_000023).

Cystic fibrosis—cystic fibrosis (CF) gene (Accession No. NM_000492).

Adenoviral Helper Vectors

Adenoviral helper vectors are used in conjunction with the high-capacity adenoviral vectors of the invention to facilitate their construction and propagation. The helper adenovirus provides all or most of the required early and late proteins necessary for replication.

Typically, the helper vector has loxP sites or FRT sites flanking the packaging signal such that packaging of the helper vector is avoided, resulting in preferential packaging of the high-capacity adenoviral genome.

In one embodiment, the invention provides an adenoviral helper vector comprising a sequence selected from SEQ ID NOs:1-13 and 18-32, or a sequence at least 50% identical thereto, that lacks the E1 region and comprises loxP sites (SEQ ID NO:221) or FRT sites (SEQ ID NO:222), wherein the loxP or FRT sites are positioned such that the first is downstream of the part of the sequence corresponding the positions defined in Table 1, column 3, respectively, and the second is upstream of the position of the deleted E1 region and downstream of the part of the sequence corresponding to the positions defined in Table 1, column 4, respectively.

In one embodiment, the invention provides an adenoviral helper vector comprising a sequence selected from SEQ ID NOs:1-13 and 18-32, or a sequence at least 50% identical thereto, that lacks the E1 region and comprises loxP sites (SEQ ID NO:221) or FRT sites (SEQ ID NO:222), wherein the loxP or FRT sites are positioned such that the first is downstream of the part of the sequence corresponding to SEQ ID NOs:65-77 and 82-96, respectively, and the second is upstream of the position of the deleted E1 region and downstream of the part of the sequence corresponding to SEQ ID NOs:33-45 and 50-64, respectively.

Preferably, the sequence is at least 60%, 70%, 80%, 85%, 90%, 95%, 96%, 97%, 98%, 99%, 99.5% or 99.9% identical to a sequence selected from SEQ ID NOs:1-13 and 18-32.

Hybrid helper vectors may be constructed as described above for the first-generation vectors of the invention.

Adenoviral Vaccine Vectors

Adenoviral vectors can also be used as vaccine vectors to deliver and express transgenes from a pathogen to raise an immune response. Adenoviral vectors tend to induce strong humoral and especially strong T cell responses to the expressed antigen[25].

Adenoviral vaccine vectors can be replication-competent or replication-deficient. The immune response varies depending on the adenovirus serotype, and consequently the protection efficiency against the vaccine antigen may be improved using adenoviral vectors based on adenoviruses from the different serotypes forming part of the library disclosed herein[24].

Replication-competent adenovirus vectors have the E3 gene deleted and replaced by heterologous DNA. The antigen may be expressed as part of an antigen expression cassette (e.g. under the control of a constitutive or inducible promoter), or via a bicistronic IRES sequence or a P2A peptide in the context of an early or late adenovirus transcription unit. Preferably, an antigen expression cassette is inserted into the E3 region. This may be done, for example, using the strategy described in Example 1 for the GFP/luciferase tagged adenoviruses. Further information regarding adenovirus vectors for use in vaccination may be found in reference 25, which is incorporated herein by reference.

Accordingly, in one embodiment, the invention provides an adenoviral vaccine vector comprising a gene encoding and capable of expressing an antigen. The vaccine vector may be a first generation adenoviral vector as described above, or a high-capacity adenoviral vector as described above.

The antigen may be from any pathogen, but is preferably from human immunodeficiency virus (HIV), Ebolavirus, Zika virus, hepatitis B virus, hepatitis C virus, influenza virus, *Mycobacterium tuberculosis*, or *Plasmodium falciparum*.

Suitable HIV antigens include (but are not limited to) Gag, Pol and Nef[26]. Suitable Ebolavirus antigens include the EBOV glycoprotein[27]. Suitable Zika virus antigens include Zika virus glycoproteins. Suitable hepatitis B antigens include the surface antigen (HBsAg). Suitable hepatitis C antigens include N53-5B[28]. Suitable influenza virus antigens include neuraminidase (NA), hemagglutinin (HA), nucleoprotein (NP) and matrix protein (MP).

Producer Cell Lines

The adenovirus vectors and helper vectors of the invention may lack the E1 region. However, this region contains genes necessary for viral replication, and so E1-expressing cell lines are required in order to generate adenoviral particles for delivery of the vectors to cells.

Accordingly, in one embodiment, the invention provides a cell encoding, and capable of expressing, an adenoviral E1 region derived from SEQ ID NO:1-3, 5-8, 10-12, 14-15, 17-25 or 27-32, or a sequence at least 70% identical to said E1 region. Such cells are used for producing adenovirus vectors according to the invention.

Preferably, the sequence is at least 80%, 85%, 90%, 95%, 96%, 97%, 98%, 99%, 99.5% or 99.9% identical to the adenoviral E1 region derived from SEQ ID NO:1-3, 5-8, 10-12, 14-15, 17-25 or 27-32.

In some embodiments, the invention provides a eukaryotic cell that has been transfected with an adenovirus vector as described herein that has been released from the adenovirus plasmid by restriction enzyme digestion.

The cell may further be capable of expressing Cre recombinase (Accession No. P06956) or Flp recombinase (Accession No. P03870). This is useful when using a helper vector in which the packaging signal is flanked by loxP or FRT sites, respectively, to allow preferential packaging of the helper-dependent vector over the helper vector, as discussed above.

Preferred cell lines include HEK293, HeLa and A549, but other cells can also be used.

Oncolytic Adenoviral Vectors

Oncolytic adenoviruses can be used in cancer therapy. Selective replication of these viruses in cancer cells can lead to killing of infected cells by virus-mediated cytolysis, and spreading to neighbouring tumour cells to continue the oncolytic process.

Oncolytic adenoviral vectors should be replication competent. That is, the oncolytic adenovirus should still be able to assemble and release new virus particles to infect neighbouring cells. Therefore it should contain at least all essential genes (transcription units E1, E2, E4 and L1-L5). E1 and E2, which are mainly responsible for virus replication, can be mutated or partially deleted to enhance replication efficiencies or to render the recombinant virus tumour-specific.

In one embodiment, the invention provides an oncolytic adenoviral vector comprising an E1 region derived from SEQ ID NOs:1-8, 10-12, 14-15, 18-25 or 27-32, or a sequence at least 70% identical to said E1 region. Preferably, the sequence is at least 80%, 85%, 90%, 95%, 96%, 97%, 98%, 99%, 99.5% or 99.9% identical to said E1 region.

Preferably, the oncolytic vector further comprises:
a) an E2 region derived from SEQ ID NOs:1-8, 10-12, 14-15, 18-25 or 27-32, or a sequence at least 70% identical to said E2 region;
b) an E4 region derived from SEQ ID NOs:1-8, 10-12, 14-15, 18-25 or 27-32, or a sequence at least 70% identical to said E4 region;
c) an L1 region derived from SEQ ID NOs:1-8, 10-12, 14-15, 18-25 or 27-32, or a sequence at least 70% identical to said L1 region;
d) an L2 region derived from SEQ ID NOs:1-8, 10-12, 14-15, 18-25 or 27-32, or a sequence at least 70% identical to said L2 region;
e) an L3 region derived from SEQ ID NOs:1-8, 10-12, 14-15, 18-25 or 27-32, or a sequence at least 70% identical to said L3 region;
f) an L4 region derived from SEQ ID NOs:1-8, 10-12, 14-15, 18-25 or 27-32, or a sequence at least 70% identical to said L4 region; and
g) an L5 region derived from SEQ ID NOs:1-8, 10-12, 14-15, 18-25 or 27-32, or a sequence at least 70% identical to said L5 region.

Preferably, the degree of sequence identity is at least 80%, 85%, 90%, 95%, 96%, 97%, 98%, 99%, 99.5% or 99.9%, for each of the regions.

The E1 and/or E2 region of the oncolytic vector may be mutated or partially deleted to enhance replication efficiency and/or tumour specificity (e.g. specificity of replication in tumour cells). For example, for achieving tumour cell specificity, a deletion may be made in the early gene E1B that inactivates p53. Suitable deletions have been made in HAd5-based vectors (ONYX-015 and H101); however, any deletion in E1B that has the effect of inactivating p53 may be used. Such viruses are useful in p53-functional cells. Alternatively, or in addition, oncolytic adenoviruses may contain a 24 bp deletion in the CR2 region of the DA region (as in AdΔ24). This mutation helps to restrict replication to cancer cells with mutated pRb (retinoblastoma protein). Further details of these and other mutations to enhance replication specificity can be found in reference 29 and the references cited therein (which are incorporated herein by reference).

Part or all or the E3 region may also be mutated or deleted to enhance antitumour effects. For example, deletion of the E3B gene enhances antitumour effects in immunocompetent mice[30].

The serotype from which viral sequences are derived may also be chosen to maximise replication. For example, vectors based on the hAd6 sequences disclosed herein appear to have enhanced oncolytic activity relative to human adenovirus 5 (see Example 6). Without being bound by any particular theory, it is thought that this enhanced oncolytic activity may be the result of enhanced replication. Vectors with enhanced replication or enhanced oncolytic activity relative to human adenovirus 5 are particularly preferred. The use of vectors comprising the Ad6 sequence in embodiments which comprise oncolysis is therefore encompassed by the present invention.

Besides directly genetically modifying adenoviral genes as discussed above, the virus can be armed using genes which enhance tumour cell killing or replication. Enhancing replication and production of new progeny is highly desirable, as in many cases virus-induced cell killing is not efficient enough.

The oncolytic vectors of the invention may further comprise:
a) a gene that enhances replication;
b) an immune-modulatory transgene;

c) a suicide gene or an interfering nucleic acid that enhances cell killing;
d) a gene or interfering nucleic acid that renders cells more sensitive to apoptosis or therapy with other drugs;
e) a tumour- or tissue-selective promoter; and/or
f) a gene for modulation of the tumour microenvironment.

a) Genes that Enhance Replication

Replication can be enhanced by adding e.g. the P19 gene (Accession number: Q712F9) to oncolytic vectors of the invention[31].

b) Immune-Modulatory Transgenes

Immunostimulatory genes can recruit immune cells to tumours and activate them. Recruitment of the immune system helps to destroy the primary tumour as well as having the potential to act on and clear metastatic cells. Genes encoding cytokines such as monocyte chemotactic protein 3 (MCP3) or granulocyte-macrophage colony-stimulating factor (GM-CSF) can be included in the oncolytic vectors. Other cytokines also result in enhanced immune responses and antitumour toxicity, for example tumour necrosis factor alpha (TNFα) and interferon gamma (IFNγ). Various interleukins and heat shock proteins can also be used[33].

c) Suicide Genes and Interfering Nucleic Acids that Enhance Cell Killing

Genes which enhance cell killing allow greater efficacy, as viruses can more easily escape from infected cells and infect neighbouring tumour cells. "Suicide genes" that encode prodrug-converting enzymes that convert non-toxic prodrugs to toxic products, are particularly effective as the toxic products can lead to killing of neighbouring, non-infected cells. For example, the herpes simplex virus thymidine kinase gene (HSV-TK) can be used in combination with ganciclovir, and/or cytosine deaminase (CD) can be used in combination with 5' fluorocytosine[33].

d) Genes or Interfering Nucleic Acids that Render Cells More Sensitive to Apoptosis or Therapy with Other Drugs Genes that render cells more sensitive to apoptosis allow greater efficacy in killing of tumour cells. For example, human tumour suppressor genes such as p53, or viral genes which stimulate cell senescence such as the Ad death protein (E3-11.6K) may be incorporated into vectors of the invention. The Ad death protein also enhances viral spread. Other human genes that can be used include suppressor of cytokine signalling 3 (socs3), second mitochondria-derived activator of caspases (Smac), X-linked inhibitor of apoptosis protein (XIAP)-associated factor 1 (XAF1), antioxidant enzyme manganese superoxide dismutase (MnSOD), and TNF-related apoptosis-including ligand (TRAIL). Interfering nucleic acids against antiapoptotic proteins can also be used. For example, antisense RNAs against cellular checkpoint proteins (e.g. polo-like kinase 1 (plk1), checkpoint kinase 1 (chk1) and checkpoint kinase 2 (chk2)), or small interfering RNAs (siRNAs) against the oncogene K-ras have previously been used to enhance antitumour effects[33]. Some of these genes and interfering nucleic acids result in induced synergistic oncolytic effects when combined with chemotherapeutic agents such as 5-fluorouracil and cisplatin[33].

e) Tumour- or Tissue-Selective Promoters

Tumour or tissue-selective promoters allow further specificity of replication in tumour cells. For example, CN706 has a prostate-specific antigen promoter-driven E1 cassette, which allows selective, androgen-dependent replication in prostate cells[32].

f) Genes for Modulation of the Tumour Microenvironment

Tumours rely on processes such as angiogenesis and modulation of the extracellular matrix, and so disruption of these processes can have antitumour effects. Accordingly, the oncolytic vectors may carry transgenes that act on extracellular matrix components, such as tissue inhibitor of metalloproteinase 3 (TIMP3), or transgenes that inhibit angiogenesis, such as endostatin, Flt-1 (a VEGF inhibitor), or interfering RNAs targeted against angiogenesis-promoting factors such as VEGF.

The above transgenes may be placed under the control of endogenous viral gene control elements, or may be under the control of exogenous promoters. Exogenous promoters may be constitutive or inducible. Further details of suitable transgenes and promoters as discussed above can be found in references 29 and 33 and the references cited therein (which are incorporated by reference herein).

As noted above, the fiber gene region is primarily responsible for cell tropism. If the target tumour cells express a receptor to which a fiber protein from the adenoviral library binds, an oncolytic vector can be based on this adenoviral serotype, or a hybrid oncolytic vector may be constructed comprising only the fiber gene (or the shaft and knob regions thereof) from said adenoviral serotype, as described above for the first-generation vectors of the invention.

Pharmaceutical Compositions

The invention also provides pharmaceutical compositions comprising the adenoviral vectors of the invention, including vectors for use in gene therapy, vaccine vectors and oncolytic vectors. The pharmaceutical compositions comprise the vector of the invention and a pharmaceutically-acceptable carrier.

The pharmaceutical compositions of the invention may comprise further excipients.

For example, a pharmaceutical composition comprising an oncolytic adenoviral vector of the invention may comprise a polymer or polyethylene glycol coating for the oncolytic vector. This may aid immune evasion and increase delivery to the tumour[34,35].

Compositions of the invention may comprise further therapeutic agents in addition to the adenoviral vector. For example, compositions comprising an oncolytic vector may comprise one or more further chemotherapeutic agents (e.g. 5-fluorouracil and cisplatin), particularly if the oncolytic vector increases susceptibility to therapy with other drugs.

Methods of Treatment/Use in Therapy

The adenoviral vectors or the oncolytic adenoviruses of the invention may be used in therapy. The invention also provides a method of treatment comprising administering an adenoviral vector of the invention to a patient.

For example, adenoviral vectors of the invention may be used in gene therapy. Such vectors include a transgene, for example the transgenes discussed above for the treatment of von Willebrand disease, haemophilia A, beta thalassemia, muscular dystrophy and cystic fibrosis. However, the invention is not limited to treatment of these disorders, and in principle, the vectors of the invention can be used to treat any genetic disorder in which replacement of a mutant allele with a non-mutant copy could restore physiological function. Vectors for use in gene therapy include the first generation adenoviral vectors and the high-capacity adenoviral vectors described above. Where stable integration of transgenes would be beneficial, the adenovirus-Sleeping Beauty hybrid vectors of the invention can be used. The CRISPR/Cas9 high-capacity vectors can be used to facilitate in vivo gene correction to treat genetic diseases, as discussed above.

In addition, the CRISPR/Cas9 vectors of the invention can be used to treat infectious diseases, for example as an antiviral approach to cut and destroy viral genomes.

Adenoviral vaccine vectors of the invention can be used as prophylactic and/or therapeutic vaccines. Vaccine vectors can be used to protect against various diseases, for example including HIV, Ebola, Zika virus disease, hepatitis B, hepatitis C, influenza, tuberculosis or malaria.

Oncolytic vectors of the invention can be used to treat conditions involving the formation of benign and/or malignant tumours, including cancer. For example, the oncolytic vectors can be used to treat carcinoma (e.g. squamous cell or nasopharyngeal), colorectal cancer, hepatocellular carcinoma, lung cancer, mesothelioma, prostate cancer, breast cancer, ovarian cancer, bladder cancer, glioma etc.

The vectors of the invention may be administered locally or systemically. Systemic administration may include intravenous, intraarterial, intraperitoneal, intramuscular, intramuscular or subcutaneous administration. The vectors may be administered mucosally (e.g. orally or nasally). Local administration can include e.g. local delivery to target tissues for gene therapy (e.g. intrapleurally), or intratumoral or intracavitary delivery for oncolytic adenoviruses.

Vectors for use in therapy may be administered in conjunction with other therapeutic agents, either as part of the same composition, or as separate compositions administered together or sequentially. For example, treatment with an oncolytic vector may be administered in conjunction with other chemotherapeutic agents (e.g. 5-fluorouracil and cisplatin), or may be used in conjunction with e.g. radiotherapy.

Methods of diagnosis are also provided by the invention. Advantageously, a method for determining whether an adenovirus is present in a sample, as described herein, may be used for determining whether a disease is being caused by an adenoviral infection. Thus, the invention further provides a method for diagnosing a disease, e.g. an infection, as being caused by an adenovirus, comprising carrying out a method as described above, wherein the sample is a clinical sample from the patient (e.g. blood, saliva, urine or serum) or genomic DNA derived from the sample. In some embodiments the patient is selected from a human or non-human mammal, for example, horse, dog, cat, cow, goat, sheep, rabbit, mouse, rat or guinea pig. In some embodiments, the patient is a human. The invention further provides a method for determining the identity of an adenovirus in a patient sample by carrying out a method as described above. In some embodiments, the disease is selected from a disease of the respiratory tract, eye, intestine, urinary tract and nervous system. In some embodiments, the disease of the respiratory tract is a respiratory infection, for example, bronchiolitis, croup, or viral pneumonia. In some embodiments, the disease of the intestine is gastroenteritis or diarrhea. In some embodiments, the disease of the eye is conjunctivitis, pharyngoconjunctival fever, or keratoconjunctivitis. In some embodiments, the disease of the urinary tract is a urinary tract infection or hemorrhagic cystitis. In some embodiments, the disease is meningitis or encephalitis. In some embodiments the disease is febrile respiratory disease.

Methods of Generating Adenoviral Vectors

The invention provides a method of generating an adenoviral vector or helper vector as defined above. This includes methods of producing the vaccine vectors or oncolytic vectors as defined above.

In one embodiment, a method of generating an adenoviral vector comprises cloning an adenoviral sequence using linear to linear homologous recombination (LLHR). In one embodiment, the invention provides a method for cloning an adenoviral sequence, comprising:
  a) providing a sample comprising a first linear nucleic acid molecule which is an adenoviral genome;
  b) providing a linearized plasmid which shares at least two regions of sequence homology with the first nucleic acid molecule; and
  c) bringing the first nucleic acid molecule and the linearized plasmid into contact in the presence of a 5' to 3' exonuclease and an annealing protein such that the first linear nucleic acid and the linearized plasmid recombine to form a circular plasmid containing an adenoviral sequence.

In some embodiments, the adenoviral sequence is an adenoviral sequence as disclosed herein. In one embodiment the first linear nucleic acid molecule comprising an adenoviral sequence is present in a biological fluid obtained from a human or other non-human mammal. In some embodiments, the sample is blood, serum, spinal fluid, saliva and/or urine. In some embodiments, the sample is a mixture. In some embodiments, the sample is a clinical sample. This mixture may, in some embodiments, comprise adenoviral genomic DNA and eukaryotic genomic DNA, for example human genomic DNA. Advantageously the method of the present invention allows adenoviruses to be cloned directly from a biological sample without requiring a step of purifying the DNA before carrying out the cloning step. For example, instead of using a purified adenovirus genome, a DNA mixture isolated from cell/virus lysate can be used. In some embodiments, the method further comprises a step of amplifying the adenovirus in a cell line before lysing the cells. Thus, in some embodiments, the first linear nucleic acid molecule is present in a cell/virus lysate or is present in a DNA mixture isolated from cell/virus lysate. In some embodiments, the method involves co-electroporating the first linear nuclear molecule present in a mixture isolated from cell/virus lysate into a host cell together with the plasmid of step b) such that homologous recombination can occur. In some embodiments, the method comprises a step of phenol-chloroform extraction to isolate the adenoviral DNA from the sample. In some embodiments, the phenol-chloroform extraction involves taking the interphase protein-DNA complexes. In some embodiments, the mixture comprising adenoviral DNA is treated with proteinase K. In some embodiments, viral genomic DNA is extracted, e.g. from purified particles, by the addition of proteinase K, subsequent phenol-chloroform extraction, and ethanol precipitation.

In some embodiments, less than 2 ug (e.g. less than 1.75 ug, less than 1.5 ug, less than 1.25 ug) viral genomic DNA is used in the cloning method. In some embodiments, more than 200 ng (e.g. more than 300 ng, 500 ng, 700 ng, 800 ng, 900 ng) viral genomic DNA is used in the cloning method. In some embodiments, the amount of plasmid vector used in the cloning method is about the same as the amount of viral genomic DNA. For example, in some embodiments, about 1 ug viral genomic DNA is used in the cloning method together with about 1 ug plasmid vector. As shown in FIG. 2, very good efficiencies of homologous recombination are obtained using these amounts.

In embodiments in which it is desired to clone an adenovirus of unknown sequence, the method may comprise amplifying the adenovirus in a cell line, lysing the cells and purifying the virus from the crude cell lysate, e.g. by CsCl gradient, followed by viral genome isolation and sequence verification. Once the sequence of the ITR regions has been obtained, the method of cloning described herein can be used to clone the full length adenovirus. However, as there is often a degree of sequence homology between the ITR regions of different adenoviruses, it is possible to use a plasmid that has been designed to have sequence homology to the ITRs of one adenovirus to clone a different adenovirus, and the present invention also encompasses such embodiments.

The direct cloning method described herein advantageously provides a more efficient and quicker method for cloning full length adenoviral genomes than was previously available. Previously, most adenoviral cloning techniques involved modularly cloning regions of adenoviral genes and stitching them together in a BAC vector. Other studies which used homologous recombination based techniques to clone adenoviral genomes into plasmids used highly inefficient techniques which required long homology arms and pure concentrated forms of adenoviral DNA. For example, Renault et al. (Virol. Methods 2002) uses *E. coli* Top10F', which is an *E. coli* strain that utilizes endogenous recA minus recombination, which is very inefficient.

Preferably, the linearized plasmid is designed so that it comprises a region of sequence homology with the 5' ITR of the adenoviral sequence in the first linear nucleic acid molecule and a region of sequence homology with the 3' ITR of the adenoviral sequence in the first linear nucleic acid molecule. In some embodiments, the region of homology is about 50 nt in length, for example, 50 nt, 50-55 nt, 50-60 nt, 50-70 nt, 45-50 nt, 40-50 nt, 30-50 nt, 45-55 nt, 40-60 nt, 30-70 nt or 40-80 nt in length. The skilled person will understand how to design the regions of sequence homology with a sufficient amount of sequence homology for homologous recombination to take place. In some embodiments, the region of sequence homology is 100% identical with the respective region of the adenoviral sequence. In some embodiments, there is a lesser degree of sequence identity (e.g. more than 90%, more than 95%, more than 98%), but there is sufficient sequence homology for homologous recombination to occur. This enables a plasmid vector designed to clone a first adenovirus to be used to clone a second adenovirus whose ITR regions share sufficient sequence homology with the first adenovirus. In some embodiments, the region of homology is only to a part of the ITR sequence rather than to the full length ITR sequence. In some embodiments, the region of homology is to the whole length of the ITR sequence. The 5' ITR and 3' ITR sequences are at the 5' and 3' ITR of the adenoviral genome and so designing the linearized plasmid so that these are the regions to be recombined ensures that the full length genome is cloned into the plasmid backbone. It would be straightforward for the skilled person to obtain the 5' and 3' ITR sequences from an adenoviral genome sequence, for example, from an adenoviral genome sequence as disclosed herein. In some embodiments, the 5' and 3' ITR sequences are from an adenoviral genome sequence as presented in Table 1, columns 3 and 5 respectively.

Accordingly, in some embodiments, the first linear nucleic acid molecule comprises a full length adenoviral genome sequence. In some embodiments, such a sequence will be present in the sample because of the presence of adenovirus in the sample. Preferably, the adenoviral sequence is the full length adenoviral genome sequence contained within any one of SEQ ID Nos 1-32 and/or 1411, for example, contained within any one of SEQ ID Nos 1-15, 17-32 and/or 1411 or contained within any one of SEQ ID NOs: 1-3, 5-8, 10-12, 14-15, 17-25 and 27-32 and/or 1411, or contained within any one of SEQ ID NOs: 1-3, 5-8, 10-12, 14-15, 17-25 and 27-32, or a sequence at least 50% identical thereto.

In preferred embodiments, the circular plasmid formed in step c) comprises a full length adenoviral genome sequence. However, in some embodiments, the adenoviral genome sequence cloned into the circular plasmid in step c) is missing one or more nucleotides at its 5' and/or 3' ends because one or both regions of sequence homology did not extend all the way to the 5' and/or 3' terminus, respectively, of the ITR sequence. For example, in some embodiments, the adenoviral genome sequence is missing less than 3, 5, 10, 15, 20, 25, 30, 35, 40, 50, 75, 100, 125 or 135 nucleotides from its 5' and/or 3' ends.

Accordingly, in a preferred embodiment there is provided a method for cloning an adenoviral genome sequence, comprising:
  a) providing a sample comprising a first linear nucleic acid molecule which is an adenovirus, wherein the sample has not been subjected to a step of DNA purification;
  b) providing a linearized plasmid which shares at least two regions of sequence homology with the first nucleic acid molecule, wherein the first and second regions of homology are to the 5' ITR and 3' ITR of the adenovirus of part a); and
  c) bringing the first nucleic acid molecule and the linearized plasmid into contact in the presence of a 5' to 3' exonuclease and an annealing protein such that the first linear nucleic acid and the linearized plasmid recombine to form a circular plasmid containing the adenoviral genome sequence.

Any suitable linearized plasmid may be used. In some embodiments, the linearized plasmid comprises homology arms (HA) for directed cloning containing the 5' and 3' ITR sequences, one or more selection markers and an origin of replication. In some embodiments, the linearized plasmid comprises homology arms (HA) for directed cloning containing the 5' and 3' ITR sequences, one or more selection markers (e.g. the chloramphenicol resistance gene) and an origin of replication (e.g. the p15a origin). In some embodiments, the linearized plasmid comprises homology arms (HA) for directed cloning containing the 5' and 3' ITR sequences, one or more selection markers (for example, ccdB10 and ampicillin for advanced positive and counter selection), an origin of replication (e.g. p15A) and an antibiotic resistance gene (e.g. the chloramphenicol resistance gene). In some embodiments, the linearized plasmid is selected from a p15A origin-based vector, a pBR322 origin-based vector, a fosmid, a pUC origin-based vector or a ColE1 origin-based vector. Medium copy plasmids are preferred, for example, p15A, pBR322, pR6K, pRK2, pBBR1 and Inc-based plasmids, in particular p15A origin-based vectors. In some embodiments, the medium copy plasmid is p15A-cm-adHA, as described herein. In some embodiments, the plasmid is present in about 10 copies in each cell, for example 10 copies, 9-11, 8-12, 8-11 or 6-12 copies. Preferably, the plasmid used for cloning the adenovirus genome sequence is not a BAC. In some embodiments, the plasmid is a shuttle vector. In some embodiments the plasmid is less than 4 kb in length, for example, less than 3.5 kb, 3 kb, 2.5 kb, 2 kb, 1.5 kb or 1 kb in length.

Cloning the adenoviral genome into a medium copy plasmid provides a number of advantages compared to prior art methods which involved cloning adenoviral sequences into low copy BACs. For example, the present adenoviral plasmids allow a higher concentration of adenoviral vector to be obtained and increase the efficiency of transfection of the released adenovirus vectors into cells. The plasmid backbones described herein are more stable than the prior art backbones and make it possible to clone complete adenovirus genomes in a high-throughput manner without introducing recombinations or mutations into the cloned viral genome. The increased efficiency of the present method means the number of clones that need to be screened to find a correct recombinant is greatly reduced compared to the prior art methods which often required screening of around 400 clones. Advantageously, the cloning methods described herein make it possible to create a library of adenoviral genome sequences and adenoviral vectors, which was simply not feasible using the previous techniques.

Using a medium copy plasmid, such as a p15A origin plasmid, has a number of advantages compared to BACs. For example, medium copy plasmids such as p15A can be more stable than BACs. As another example, the medium copy plasmid makes the first cloning step easier become the homology arms can be ordered as oligonucleotides and attached to the plasmid by PCR in one or two steps, whereas each homology arm must be cloned into the BAC individually to generate a dedicated plasmid that then must be linearized. In addition, medium copy plasmids such as p15A may result in at least 10-time increased plasmid yields isolated from *E. coli* bacteria compared to that obtained using a BAC. Increased plasmid yields after plasmid purification compared to BAC purification procedures makes the first step of virus production (=transfection of DNA into the producer cell line) more feasible, because a sufficient amount is needed. In general the increased stability and efficiency enables high-throughput work which is in sharp contrast to conventional methods used for adenovirus genome cloning.

In some embodiments, the plasmid of step b) is linearized prior to electroporating it into a host cell in which homologous recombination occurs. In other embodiments, the plasmid of step b) is linearized in vivo, for example, using a rare site sequence-specific cutting enzyme, for example as described in reference 20.

Any suitable 5' to 3' exonuclease and annealing protein may be used. Preferably, the 5' to 3' exonuclease is full-length RecE (SEQ ID NO:1412) as described in reference 20 (incorporated herein by reference), or a protein with at least 70% sequence identity to the full-length form (preferably at least 80%, 85%, 90%, 95%, 96%, 97%, 98%, 99%, 99.5% or 99.9%) which retains the 5' to 3' exonuclease activity. The annealing protein is preferably RecT.

In some embodiments, the method comprises co-electroporating the first linear nucleic acid molecule and the linearized plasmid into a host cell that expresses full length RecE and RecT. In some embodiments, the method is carried out in a host cell in which full-length RecE is expressed under the control of an inducible promoter. In some embodiments, the host cell is an *E. coli* cell, for example, *E. coli* strain GBRed. Examples of suitable host cells are well known in the art, and are described in detail in reference 20. In some embodiments, the host cell expresses RecA and/or Red gamma.

Methods of direct cloning utilising full length RecE and RecT are described in detail in reference 20, which is hereby incorporated by reference in its entirety. Previous attempts to clone Herpes viruses using direct cloning have failed and so it is surprising that direct cloning works with adenoviruses.

In some embodiments, following the step of cloning the adenoviral genome, a step of sequencing is carried out to determine the sequence of the adenovirus.

In some embodiments, following the step of cloning the adenoviral genome, the method further comprises checking the integrity of the cloned adenoviral genome, for example, using diagnostic restriction enzyme digest and/or next generation sequencing.

In another aspect, the invention provides a cloning method as described herein to clone a viral genome sequence, preferably, a double stranded DNA viral genome sequence. In some embodiments, the virus is not an adenovirus. In some embodiments, the virus has a genome which is less than 70 kb in length, e.g. less than 65 kb, 60 kb, 55 kb, 50 kb, 45 kb, 40 kb or 35 kb in length. In some embodiments, the virus has a genome which is more than 10 kb in length, for example, more than 12 kb, 15 kb, 20 kb, 25 kb or 30 kb in length. For example, in some embodiments, the virus is between 10-70 kb in length, e.g. 15-70 kb, 15-60 kb, 20-60 kb, 20-55 kb, 20-45 kb, 25-55 kb, 25-45 kb or 35-45 kb in length. Similarly, the other methods and vectors may be used for other types of viruses. The skilled person would understand how to adapt the methodology and products described herein for different types of viruses.

The invention further provides a plasmid vector comprising a full length adenoviral genome sequence. Preferably, the plasmid has been obtained by or is obtainable by a method as described herein. Accordingly, the description provided of the adenoviral sequences and the plasmid vectors in the methodology described herein can be extrapolated to this aspect of the invention which is the plasmid vectors comprising the cloned adenoviral sequences. In some embodiments, the plasmid comprises a full length adenoviral genome sequence as described herein. For example, in some embodiments, the plasmid comprises the full length adenoviral genome sequence contained within any one of SEQ ID NOs 1-32 or 1411, or a sequence at least 70% identical thereto (preferably at least 80%, 85%, 90%, 95%, 96%, 97%, 98%, 99%, 99.5% or 99.9%). In some embodiments, the plasmid comprises the genome sequence contained within any one of SEQ ID NOs: 1-3, 5-8, 10-12, 14-15, 17-25, 27-32 and 1411, or a sequence at least 70% identical thereto (preferably at least 80%, 85%, 90%, 95%, 96%, 97%, 98%, 99%, 99.5% or 99.9%). In some embodiments, the plasmid comprises an adenoviral genome that has not previously been sequenced.

In some embodiments, the plasmid which contains the adenoviral sequence is a medium copy plasmid which comprises an origin of replication and a selectable marker such as an antibiotic resistance gene. In some embodiments, the plasmid comprises the p15A origin. In some embodiments, the plasmid is a medium copy plasmid which comprises an origin of replication, a selection marker and a full length adenoviral genome sequence, wherein the plasmid additionally comprises one or more restriction sites immediately upstream and immediately downstream of the adenoviral genome sequence, such that the adenoviral genome vector can be released from the plasmid vector. As mentioned above, in an alternative aspect of the invention, the plasmid comprises a full length viral genome sequence, which in some embodiments is not an adenoviral sequence. For example, the full length viral genome sequence may be from polyomaviruses or papillomaviruses.

The invention further provides a library of cloned adenoviral genomes. Preferably, the adenoviral genomes are full length adenoviral genomes. Thus, the invention provides a library of two or more (e.g. 2, 3, 4, 5, 6, 7, 8, 9, 10, 15, 20 or more) plasmid vectors each comprising a full length adenoviral genome sequence. Preferably, the two or more plasmid vectors have been obtained by or are obtainable by a cloning method as described herein. In some embodiments, the library comprises sequences of at least two (e.g. 2, 3, 4, 5, 6, 7, 8, 9, 10, 15, 20) different adenoviruses. For example, in some embodiments, there is a provided a library comprising two or more of the plasmid vectors comprising a full length adenoviral genome sequence that are described herein. In some embodiments, the cloned adenoviruses in the library are tagged with a reporter gene.

In another aspect, there is provided a plasmid that is suitable for use in step b) of the cloning method. The plasmid may be provided in circular form or in linearized form. For example, in some embodiments, the invention provides a plasmid comprising an origin of replication, a selection marker, and two regions of homology with the ITR regions of an adenoviral genome sequence, wherein one region has homology to the 5'ITR and a second region has homology to the 3'ITR. The descriptions of the plasmids for use in the cloning method of the invention can be extrapolated to this aspect of the invention. For example, in some embodiments, the plasmid is a medium copy plasmid such as a p15A, pBR322, pR6K, pRK2, pBBR1 or an Inc-based plasmid. In some embodiments the plasmid of this aspect of the invention will contain less than 1000 nt of adenoviral sequence, for example, less than 900, 800, 700, 600, 500, 400, 300, 250, 200, 150, 100, 50, 25, 15 or 10 nt.

The invention further provides a method for determining whether an adenovirus is present in a sample, comprising contacting the sample, or genomic DNA derived from the sample, with a linearized plasmid as described herein which comprises at least two regions of sequence homology with an adenoviral sequence in the presence of a 5' to 3' exonuclease and an annealing protein such that if an adenoviral genome sequence is present in the sample, it will recombine with the linear plasmid to form a circular plasmid containing an adenoviral sequence, and further comprising a step of determining whether a circular plasmid containing an adenoviral sequence has been formed. Advantageously, such a method may be carried out using a method for cloning an adenoviral sequence as described herein. In some embodiments, the linearized plasmid shares a region of sequence homology with the 5' ITR of an adenoviral sequence and shares a region of sequence homology with the 3' ITR of the adenoviral sequence. In some embodiments, the method further comprises the step of determining the identity of the cloned adenoviral sequence, for example, by sequencing all or part of the cloned adenoviral sequence and/or analysing the cloned adenoviral sequence using restriction enzyme digestion.

In some embodiments, the method comprises contacting a sample with a library of linearized plasmids comprising homology regions which have been designed to target different adenoviruses. In some embodiments, the method comprises contacting the sample with all the members of the library simultaneously. In some embodiments, the method comprises carrying out multiple experiments using individual members of the library. Thus, the invention further provides a library of plasmids that are suitable for use in step b) of a method for cloning as described herein, wherein the individual members of the library share regions of sequence homology with the 5' ITR and 3' ITR of different adenoviruses. In some embodiments, the library has at least 2, 3, 4, 5, 10, 15, 20, 25 or 30 members.

The invention also provides an adenoviral vector that has been released in linear form from the circular plasmid containing the adenoviral genome sequence, e.g. by restriction digestion, as described herein.

The method of generating a vector generally uses linear to circular homologous recombination (LCHR) to delete one or more regions of the adenoviral genome as discussed above. Accordingly, in one embodiment, the invention provides a method of generating an adenoviral vector or helper vector, comprising:

a) providing a first circular nucleic acid molecule comprising an adenoviral sequence selected from SEQ ID NOs: 1-32 and/or 1411, for example comprising a full adenoviral genome sequence selected from within any one of SEQ ID NOs 1-32 and 1411, or selected from within any one of SEQ ID NOs: 1-15 and 17-32 and 1411, or selected from within any one of SEQ ID NOs: 1-3, 5-8, 10-12, 14-15, 17-25 and 27-32, or a sequence at least 70% identical thereto (preferably at least 80%, 85%, 90%, 95%, 96%, 97%, 98%, 99%, 99.5% or 99.9%);

b) providing a second linear nucleic acid molecule which shares at least one region of sequence homology with the first nucleic acid molecule; and c) bringing the first and second nucleic acid molecules into contact in the presence of a 5' to 3' exonuclease and an annealing protein such that a deletion, mutation and/or insertion is introduced in the first nucleic acid molecule.

Preferably the first circular nucleic acid molecule described in step a) has been generated using the LLHR direct cloning method described above. Accordingly, the description of the adenoviral sequence and the plasmid vector described for the cloning method can be extrapolated to this aspect of the invention. Thus, there is also provided a plasmid vector as described herein which comprises the modified adenoviral genome sequence obtained by or obtainable by this method of the invention. In some embodiments, the plasmid vector comprises the sequence of an adenoviral vector as described herein.

The adenoviral vector can be released in linear form from the first circular nucleic acid molecule e.g. by restriction digestion. To release the genome by restriction digestion, the circular nucleic acid molecule will comprise restriction sites both 5' and 3' of the adenoviral sequence. Thus, in some embodiments, the linearized plasmid used in the cloning method comprises restriction sites 5' and 3' of the two regions of sequence homology (i.e. so that the resulting circular nucleic acid molecule comprising the cloned adenoviral sequence comprises the restriction sites 5' and 3' of the adenoviral sequence). Accordingly, in some embodiments, the released adenoviral vector does not comprise any plasmid sequence. In some embodiments, the released adenoviral vector comprises less than 1000 nt plasmid sequence at the 5' and/or 3' end, for example, less than 900, 800, 700, 600, 500, 400, 300, 250, 200, 150, 100, 50, 25, 15 or 10 nt.

Suitable deletions are discussed above in relation to the vectors (for example, the E1 region and/or the E3 region, and/or other early gene regions). For the high-capacity vectors, all coding sequences are deleted. For oncolytic vectors, non-essential sequences (e.g. E3 sequences) may be deleted. Alternatively, mutations may be made using the second linear nucleic acid, for example in the E1 and/or E2 region. Insertions may also be made, for example to insert a transgene or other non-adenoviral DNA, for example as discussed above. Usually, if DNA is inserted, at least some non-essential regions of the adenoviral genome are deleted to create coding capacity for the inserted DNA.

For a deletion or mutation, the linear nucleic acid may be less than 180 nucleotides in length (for example, 150 nucleotides or less, 130 nucleotides or less, 110 nucleotides or less, 100 nucleotides or less, 80 nucleotides or less, 60 nucleotides or less or 55 nucleotides or less).

In some embodiments, the second linear nucleic acid molecule shares at least two regions of sequence homology with the first nucleic acid molecule, where the regions of sequence homology have been designed to remove the intervening sequence that is present in the adenoviral sequence. For example, the sequence homology may be to either side of the E3 region to delete the entire E3 region.

Alternatively, the second nucleic acid molecule may be longer and comprise heterologous (non-adenoviral) DNA e.g. comprising one or more transgenes, between two regions of homology ("homology arms"). This leads to replacement of the deleted sequences between the homology arms in the first nucleic acid molecule with the heterologous DNA between the homology arms in the second nucleic acid molecule. Such methods are usually carried out in conjunction with a method of inserting one or more transgenes into a vector of the invention, as described below.

The first circular nucleic acid molecule may be e.g. a bacterial artificial chromosome (BAC), a p15A origin-based vector, a pBR322 origin-based vector, a fosmid, a pUC origin-based vector or a ColE1 origin-based vector. However, medium copy plasmids are preferred, for example, p15A, pBR322, pR6K, pRK2, pBBR1 and Inc-based plasmids, in particular p15A origin-based vectors.

Suitable 5' to 3' exonucleases include RecE[20] and Red alpha[36]. These exonucleases are used in conjunction with the annealing proteins RecT and Red beta, respectively. The RecE may be either full-length (SEQ ID NO:1412) or a truncated form (e.g. RecE588 or RecE602), as described in reference 20 (incorporated herein by reference), or a protein with at least 70% sequence identity to the full-length or truncated form (preferably at least 80%, 85%, 90%, 95%, 96%, 97%, 98%, 99%, 99.5% or 99.9%). The Red alpha/Red beta system is preferred. If RecE is used, truncated RecE is preferred.

In some alternative embodiments of generating a vector using linear to circular homologous recombination (LCHR) to delete one or more regions of the adenoviral genome, the first nucleic acid molecule described above which comprises the adenoviral sequence is linear (e.g. a linearized form of the circular nucleic acid molecule generated using the LLHR cloning method described herein, wherein the first nucleic acid is linearized either in vivo in the recombination-competent host cell, or is linearized in vitro) and the second nucleic acid is provided in circular form. The various embodiments described herein can be adapted to this alternative embodiment.

In some embodiments, the method of cloning using LLHR and the method of deleting one or more regions of the adenoviral genome using LCHR, as described above, are carried out in the same host cell. In some embodiments, the host cell expresses full length RecE under the control of an inducible promoter and either truncated RecE and/or Red alpha under the control of one or more different inducible promoters. In addition, in such embodiments, the host cell also expresses the corresponding annealing proteins RecT and Red beta, respectively. Advantageously, such a host cell allows independent temporal expression of the full length RecE/RecT system and the Red alpha/Red beta or truncated RecE/RecT system, such that the required recombination proteins can be activated at the point in time that they are required.

Methods of Generating Cells

The invention also provides a method of generating a cell as defined above. The method comprises transforming a cell with DNA encoding, and capable of expressing, at least an adenoviral E1 region selected from SEQ ID NOs:1-3, 5-8, 10-12, 14-15, 17-25 or 27-32, or a sequence at least 70% identical thereto (preferably at least 80%, 85%, 90%, 95%, 96%, 97%, 98%, 99%, 99.5% or 99.9%). Typically, the DNA encoding the E1 region also encodes a selectable marker (for example neomycin, puromycin, hygromycin etc.). The selectable marker allows detection of cells into which the DNA carrying the E1 region has integrated stably.

Means for expressing the E1 region and the selectable marker include e.g. an IRES or a promoter.

The method may also comprise transforming a cell with DNA encoding, and capable of expressing, Cre recombinase (Accession No. P06956) or Flp recombinase (Accession No. P03870). These cell lines are used when a helper vector is required.

Methods of Inserting Transgenes

The invention provides a method of inserting one or more transgenes into an adenoviral vector or helper vector according to the invention (including e.g. oncolytic or vaccine vectors). This method may be performed in conjunction with the method of generating an adenoviral vector as set out above.

In one embodiment, the invention provides a method of inserting one or more transgenes into an adenoviral vector or helper vector, comprising:

a) providing a first circular nucleic acid molecule comprising an adenoviral sequence selected from SEQ ID NOs:1-15 and 17-32, or for example comprising a full adenoviral genome sequence selected from within any one of SEQ ID NOs 1-32 and 1411, or selected from within any one of SEQ ID NOs: 1-15 and 17-32 and 1411, or selected from within any one of SEQ ID NOs: 1-3, 5-8, 10-12, 14-15, 17-25 and 27-32, or a sequence at least 50% identical thereto (preferably at least 60%, 70%, 80%, 85%, 90%, 95%, 96%, 97%, 98%, 99%, 99.5% or 99.9%);

b) providing a second linear nucleic acid molecule which shares at least two regions of sequence homology with the first nucleic acid molecule; and c) bringing the first and second nucleic acid molecules into contact in the presence of a 5' to 3' exonuclease and an annealing protein such that sequences between the regions of homology in the second nucleic acid molecule are introduced into the first nucleic acid molecule.

Preferably the first circular nucleic acid molecule described in step a) has been generated using the LLHR direct cloning method described above. Accordingly, the description of the adenoviral sequence and the plasmid vector described for the cloning method can be extrapolated to this aspect of the invention. Thus, there is also provided a plasmid vector as described herein which comprises the modified adenoviral genome sequence obtained by or obtainable by this method of the invention.

For vector production the adenoviral vector can be released in linear form from the first circular nucleic acid molecule e.g. by restriction digestion. To release the genome by restriction digestion, the circular nucleic acid molecule will comprise restriction sites both 5' and 3' of the adenoviral sequence.

The method may also involve a deletion of part of the adenoviral sequence, as discussed above.

The second linear nucleic acid molecule may comprise the transgene(s) of interest, such that the transgene(s) is/are inserted into the first nucleic acid molecule in one step. Alternatively, the method may be a two- or multi-step process in which the second linear nucleic acid molecule comprises e.g. a selectable marker, which is inserted into the first circular nucleic acid molecule in a first step. A second step is then carried out comprising (a) to (c) above, but with a third linear nucleic acid molecule in place of the second linear nucleic acid molecule. The third linear nucleic acid molecule carries the transgene(s) of interest, and comprises at least two regions of sequence homology with the intermediate circular nucleic acid molecule (which corresponds to the first circular nucleic acid molecule comprising sequence inserted from the second linear nucleic acid molecule).

In some embodiments, the at least two homology regions on the second linear nucleic acid molecule are designed to target the transgene to the E3 region of the adenoviral genome sequence. In some embodiments, inserting the transgene simultaneously results in deletion of sequence within the adenoviral genome sequence, e.g. the E3 region. In some embodiments, the transgene is inserted into a region corresponding to a deleted sequence in the adenoviral sequence, e.g. the deleted E3 region. In some embodiments, the transgene is inserted in the adenoviral sequence without deleting any adenoviral sequence.

Advantageously, the use of a method of inserting a transgene allows tagged adenoviral vectors to be generated. In some embodiments, the second linear nucleic acid molecule is designed to comprise homology regions to a region that is conserved between adenoviral sequences, e.g. a conserved region in the E3 region, such that different adenoviral genomes can be tagged in a high-throughput manner using identical plasmid vectors.

Suitable 5' to 3' exonucleases and annealing proteins include those described above for methods of generating the adenoviral vectors of the invention.

In some alternative embodiments of inserting one or more transgenes, the first nucleic acid molecule described above which comprises the adenoviral sequence is linear (e.g. a linearized form of the circular nucleic acid molecule generated using the LLHR cloning method described herein, wherein the first nucleic acid is linearized either in vivo in the recombination-competent host cell, or is linearized in vitro) and the second nucleic acid is provided in circular form. The various embodiments described herein can be adapted to this alternative embodiment.

Methods for Obtaining Packaged Vectors or Oncolytic Viruses

The adenoviral vector can be released in linear form from a circular nucleic acid molecule as described above, and the DNA vector purified using standard procedures. The linear DNA can be transfected into target cells for vector amplification. If the vector is replication-deficient, the cell line will be a "producer cell line" as described above, which complements for one or more essential genes missing from the adenoviral vector. If the vector is helper-dependent, then the helper vector is also transfected into the producer cell line.

Packaged vectors or oncolytic viruses can be obtained from the cells, for example by cell lysis and particle purification using standard procedures.

Helper viruses can be separated from packaged high-capacity vectors, for example by ultracentrifugation on cesium chloride density gradients and/or anion exchange and size exclusion chromatography.

Methods for Screening Potential New Drug Targets for Anti-Adenoviral Therapeutic Strategies The adenoviral library disclosed herein can also be used to screen for potential new drug targets for anti-adenoviral therapeutic strategies. Currently, there are no anti-adenoviral drugs available, and until now a system for drug screening against many different serotypes has not been available due to the lack of cloned adenoviral genomes. For this purpose, adenoviral genome sequences comprising reporter genes are constructed, based on the adenoviral library disclosed herein.

Therefore, the invention provides an adenoviral sequence selected from SEQ ID NOs:1-3, 5-12, 14-15 and 17-32, comprising one or more reporter genes and means for their expression, replacing part or all of the E3 region.

Suitable reporter genes include a gene encoding a fluorescent protein, for example green fluorescent protein (GFP), and/or a luciferase gene. Multiple reporter genes can be inserted so that different assays can be conducted. These reporter genes thereby allow the identification of the tropism of the adenovirus as they can be used to establish the level of infectivity of that adenovirus in cell lines derived from different tissues.

Vectors comprising such sequences are also provided. Preferably, the vector carrying the above sequence is a medium copy plasmid, for example, a p15A, pBR322, pR6K, pRK2, pBBR1 or an Inc-based plasmid. Plasmids with a p15A origin are particularly preferred.

In one embodiment, the invention provides a method of screening for potential anti-adenoviral drugs, comprising:
 a) infecting a cell with a vector comprising one or more reporter genes and means for their expression, as described above, in the presence and in the absence of a drug of interest;
 b) detecting the expression level of the reporter gene product in the presence and in the absence of the drug; and
 c) comparing the expression level of the reporter gene product in the presence and in the absence of the drug.

The relative expression levels of the reporter gene product(s) in the presence versus the absence of the drug give an indication of whether the drug reduces adenovirus infectivity (i.e. has anti-adenoviral activity). If the expression level is reduced in the presence of the drug, relative to the absence of the drug, it indicates lower infectivity in the presence of the drug, and therefore likely anti-adenoviral activity of the tested drug.

The above method can be used for high-throughput drug screening.

In some embodiments of the various aspects disclosed herein, the adenoviral sequence is not a sequence derived from at least one of (e.g. of 1, 2, 3, 4 or all 5 of) the adenoviruses selected from the group consisting of B3, B11, B35, C5 and D26. For example, in some embodiments of the various aspects disclosed herein, the adenoviral sequence is not a sequence derived from at least one of (e.g. of 1, 2 or all 3 of) the adenoviruses selected from the group consisting of B11, B35 and C5. For example, in some embodiments of the various aspects disclosed herein, the adenoviral sequence is not a sequence derived from at least one of (e.g. of 1, 2 or all 3 of) the adenoviruses selected from the group consisting of B3, B35 and C5. For example, in some embodiments of the various aspects disclosed herein, the adenoviral sequence is not a sequence derived from the C5 adenovirus. However, in some embodiments of the various aspects of the invention, the invention does extend to adenoviral sequences derived from at least one of (e.g. of 1, 2, 3, 4 or all 5 of) the adenoviruses selected from the group consisting of B3, B11, B35, C5 and D26.

b) Genome isolation of different Ad types visualized on an agarose gel.

Figure 2:
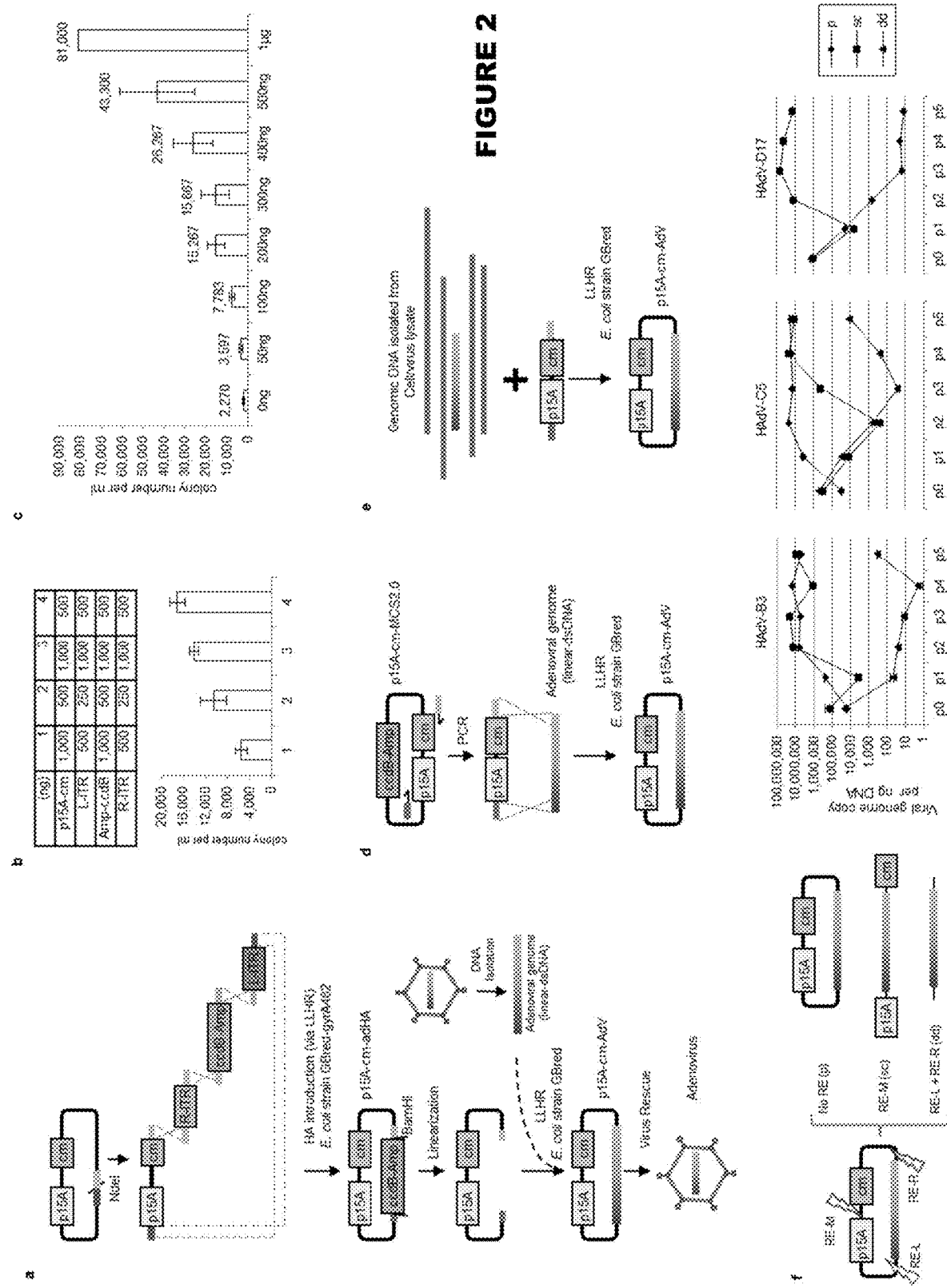

FIG. 2—Direct cloning (HTC) of Ad genomes by LLHR
a) Prototypal strategy to direct clone Ad genomes by LLHR. The shuttle vector p15A-cm-adHA was constructed by co-electroporation of four DNA fragments sharing terminal homologous arms (HAs) into the RecET expressing *E. coli* strain GBred-gyrA462, which has an R462C mutation in the GyrA subunit of DNA Gyrase that confers resistance to CcdB expression. The final vector p15A-cm-AdV was generated via a second LLHR step in RecET expressing *E. coli* strain GBred by co-electroporation of the linearised shuttle vector and the linear double-stranded adenoviral DNA (linear-dsDNA). NdeI and BamHI restriction digestion was used to linearize the circle plasmids.

b) Recombineering efficiency for shuttle vector construction using different amounts of PCR products in four experimental settings.

c) Recombineering efficiencies of viral genome cloning using various amounts of viral genomic DNA (0 to 1 µg) and 1 µg of the linearized shuttle vector. Error bars, s.d.; n=3.

d) Single-PCR based Ad genome cloning. The vector backbone p15A-cm was generated by a single PCR from a modified plasmid p15A-cm-MCs2.0. ~50 bp homology arms (HAs) were incorporated into individual Ad genomes via primer design.

e) Direct Ad genome cloning from cell/virus lysate. Instead of purified Ad genome, a DNA mixture isolated from cell/virus lysate, or a clinical sample, was co-electroporated.

f) Left panel: Strategy to rescue engineered Ads. Different molecular forms based on restriction enzyme (RE) digest for different virus rescue strategies are shown. Right panel: Influence of the genome-releasing status on virus rescue efficiency after DNA transfection into permissive cells. Y-axis indicates viral genome copy numbers isolated from cell/virus lysates collected after each passage. X-axis is the passage number after transfection. dd, completed exposed adenoviral genome released by double-digest; sc, linearized adenoviral genome released by single-cutter; p, circular plasmid. Amp, ampicillin; cm, chloramphenicol; ccdB, counter-selection marker.

Figure 3:
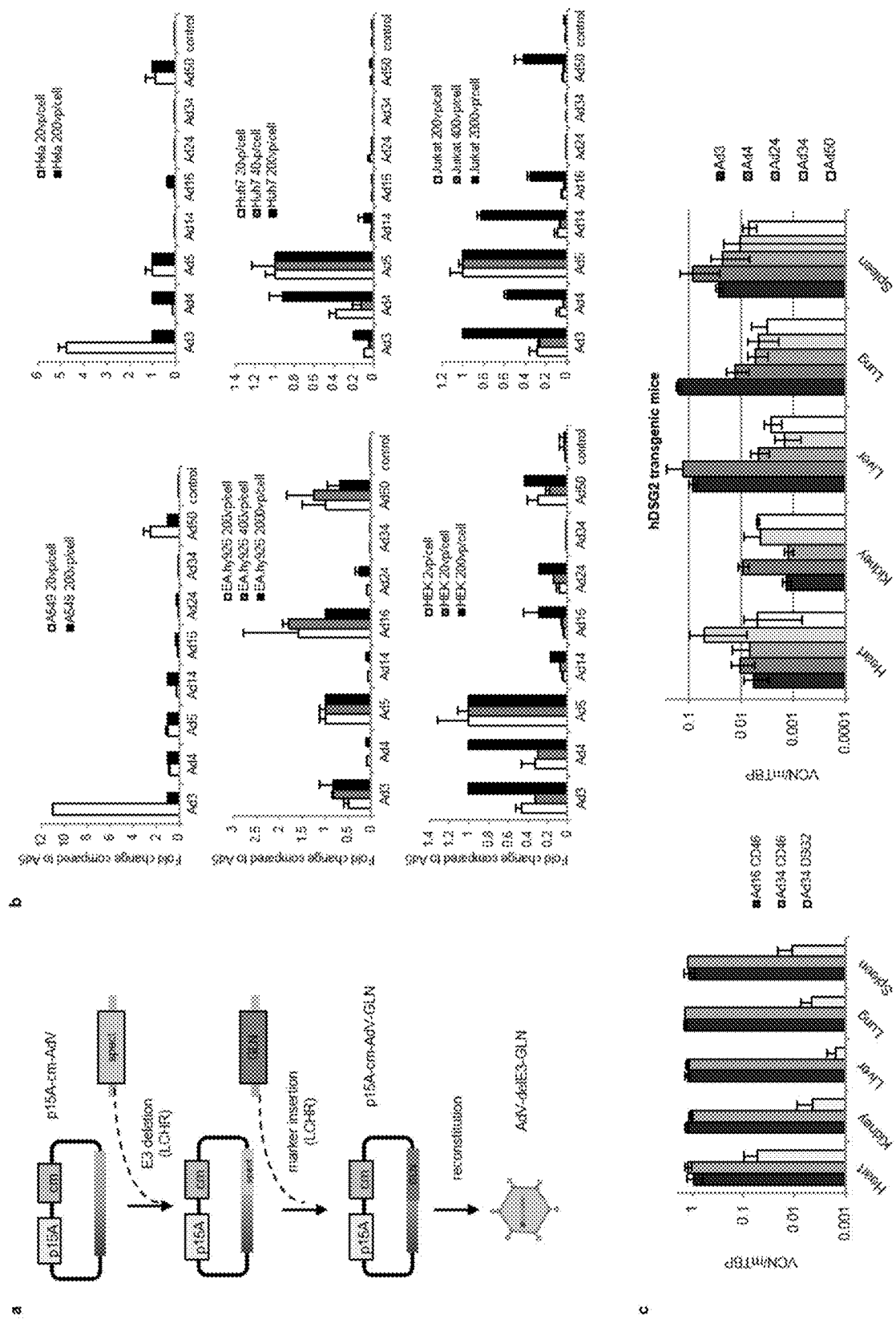

FIG. 3—Ad genome tagging and in vitro/in vivo characterisation
a) Strategy for high-throughput ad genome tagging by linear-circular homologous recombination (LCHR). The E3 region was first deleted by integration of the spect-cassette, which was then replaced by the multicistronic/triple-expression cassette (GLN).

b) In vitro characterisation of tagged Ad. Transgene expression efficiency of different Ad types was compared to the common used Ad5, and indicated as fold-change. Luciferase expression was measured by addition of furimazine substrate and indicated by luminescence units (RLU).

c) Bio-distribution study of tagged Ad in transgenic mice.

Figure 4:
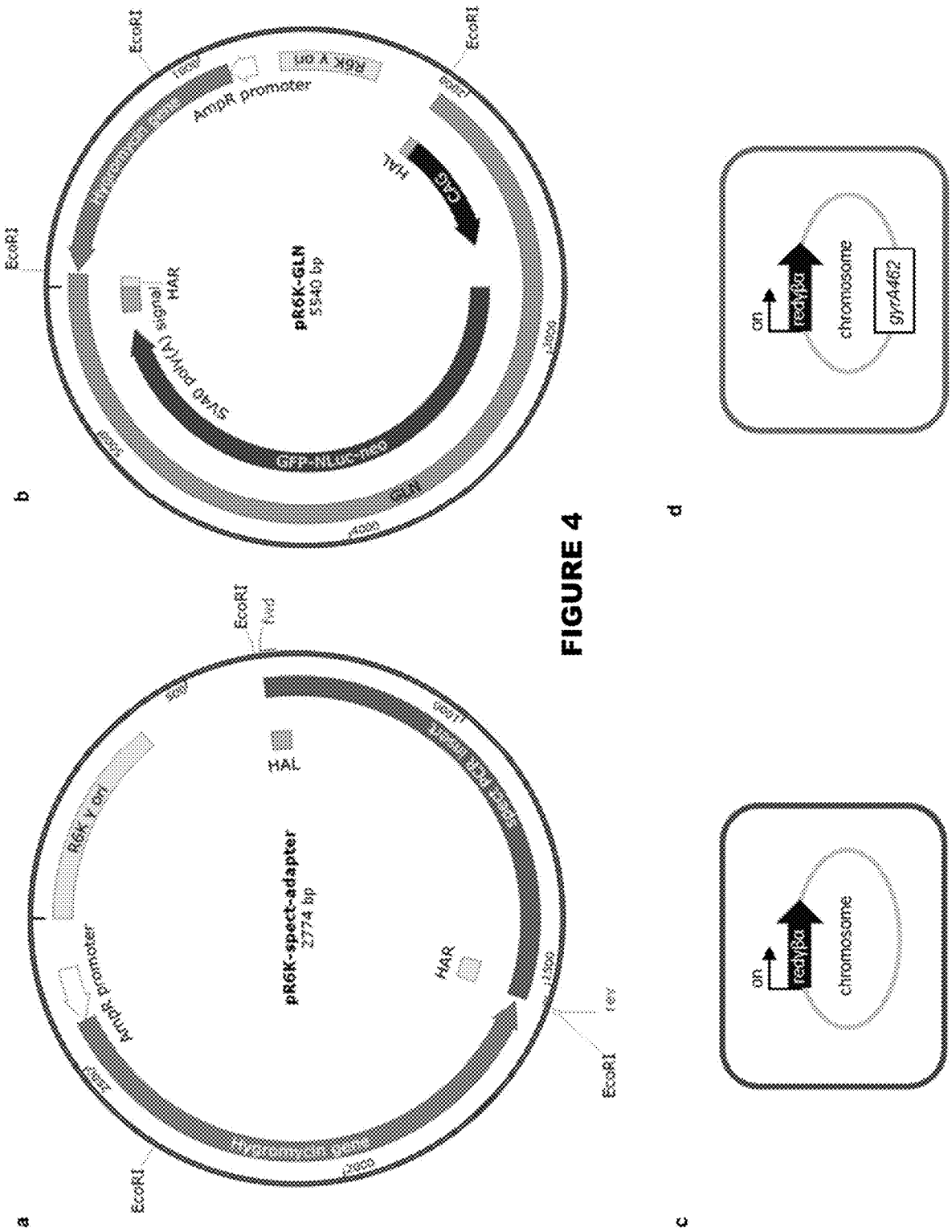

FIG. 4—Recombineering toolkit for Ad genome tagging including plasmid maps and sequences of pR6K-spect-adapter and pR6K-GLN
a) pR6K-spect-adapter serves as a PCR template to amplify selection marker spectinomycin adenyltransferase (spect), which is flanked by the same homologous arm (HAR and HAL) as the reporter cassette GLN (shown in b). EcoRI restriction enzyme digest releases the PCR template. The R6K backbone is used to avoid plasmid contamination.

b) pR6K-GLN provides the reporter gene cassette GLN which is released by EcoRI restriction enzyme digest. *E. coli* strain GB05-Red harbouring an arabinose inducible gbaA operon (redγ, redβ, redid and recA) at the ybcC locus2 mediates highly efficient LCHR. *E. coli* strain GBred-gyrA462 is generated from GB05-Red with the Arg462-coding codon CGT been changed into Cys-coding codon TGC, allowing resistance to CcdB expression[37]. All plasmid maps used in this study are created with SnapGene software.

Figure 5:
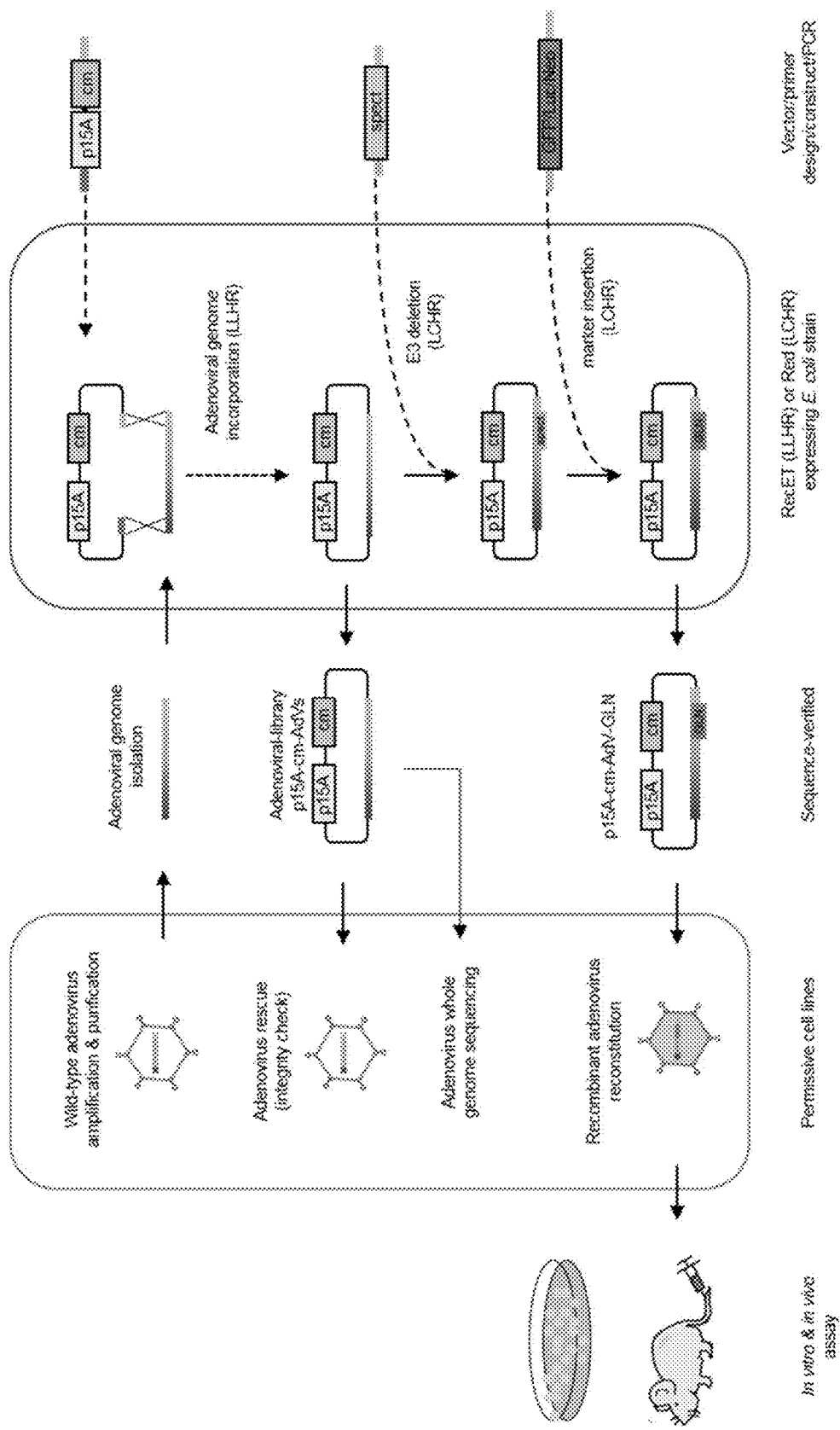

FIG. 5—Summary of the complete pipeline to study natural Ad diversity and to generate an engineered Ad library including tagging of viral genomes The process begins with wild-type adenovirus amplification in respective permissive cell lines (e.g. HeLa, HEK, A549). After virion purification the adenovirus genomic DNA is isolated and verified by sequencing and restriction enzyme digest. According to the sequence identification the shuttle vector p15A-cm-adHA is computationally designed, and constructed by co-electroporation of four DNA fragments containing homologous arms (HA) to each other into the RecET expressed *E. coli* strain, where LLHR takes place. In the next step, the adenoviral genome is incorporated into the linearised shuttle vector containing HA to each ITR end via LLHR. Sequence-verified plasmids harbouring adenoviral genomes are collected together building up an engineered adenoviral library. To prove integrity of the cloned adenovirus genomes rescue experiments were performed. Marker gene GFP/LUC tagging was mediated by linear-circular homologous recombination (LCHR). The E3 region was first deleted by integration of the ccdB-Amp cassette, which was then replaced by a P2A peptide-mediated bicistronic-expression cassette expressing a Turbo Green fluorescent protein and a NanoLuc luciferase (tGFP-Nluc) to generate p15A-cm-AdV-tGFP-Nluc. The tagged adenovirus AdV-delE3-tGFP-Nluc can be reconstituted in its permissive cell line and further evaluated in vivo.

Figure 6:
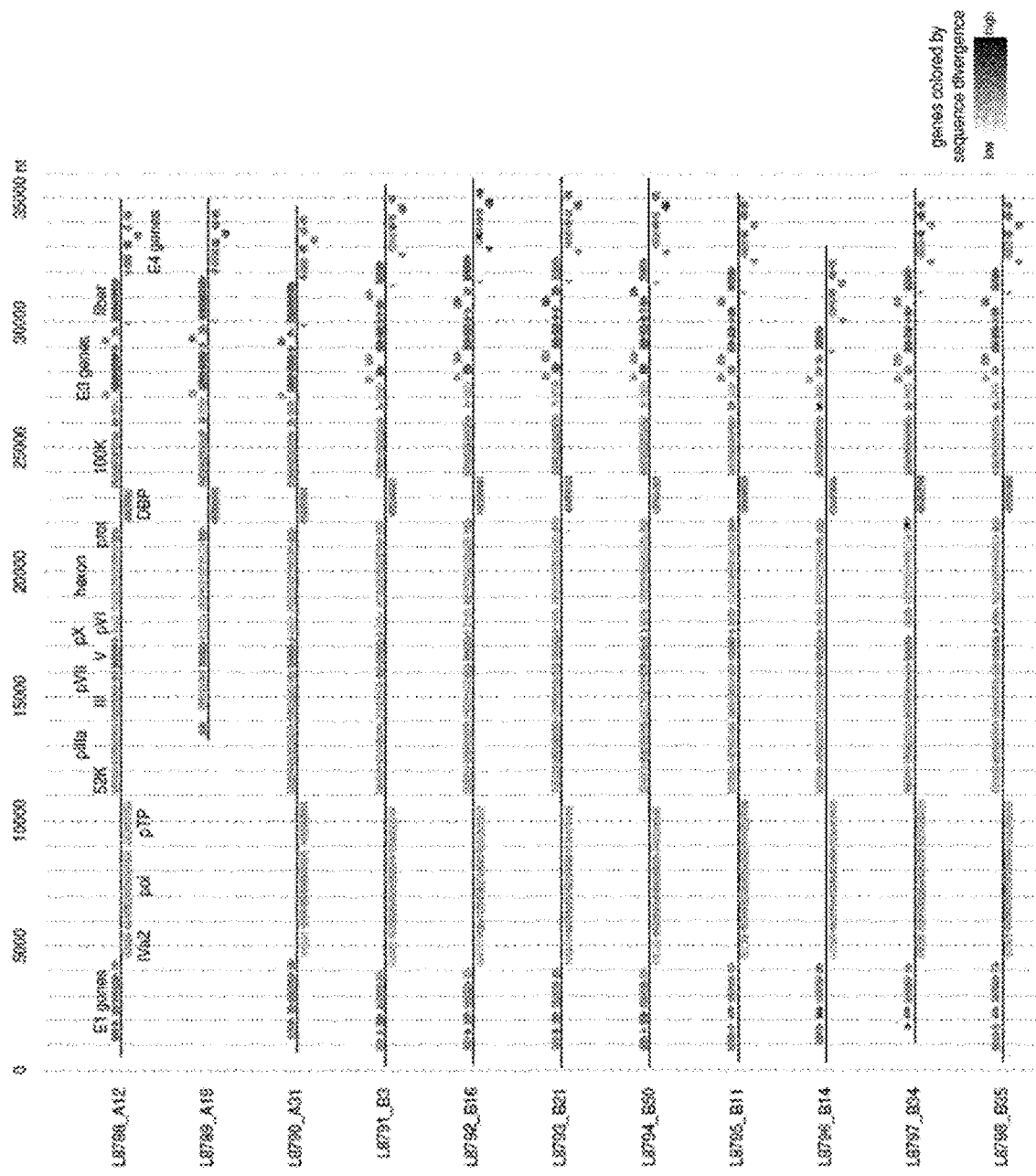
Figure 6:
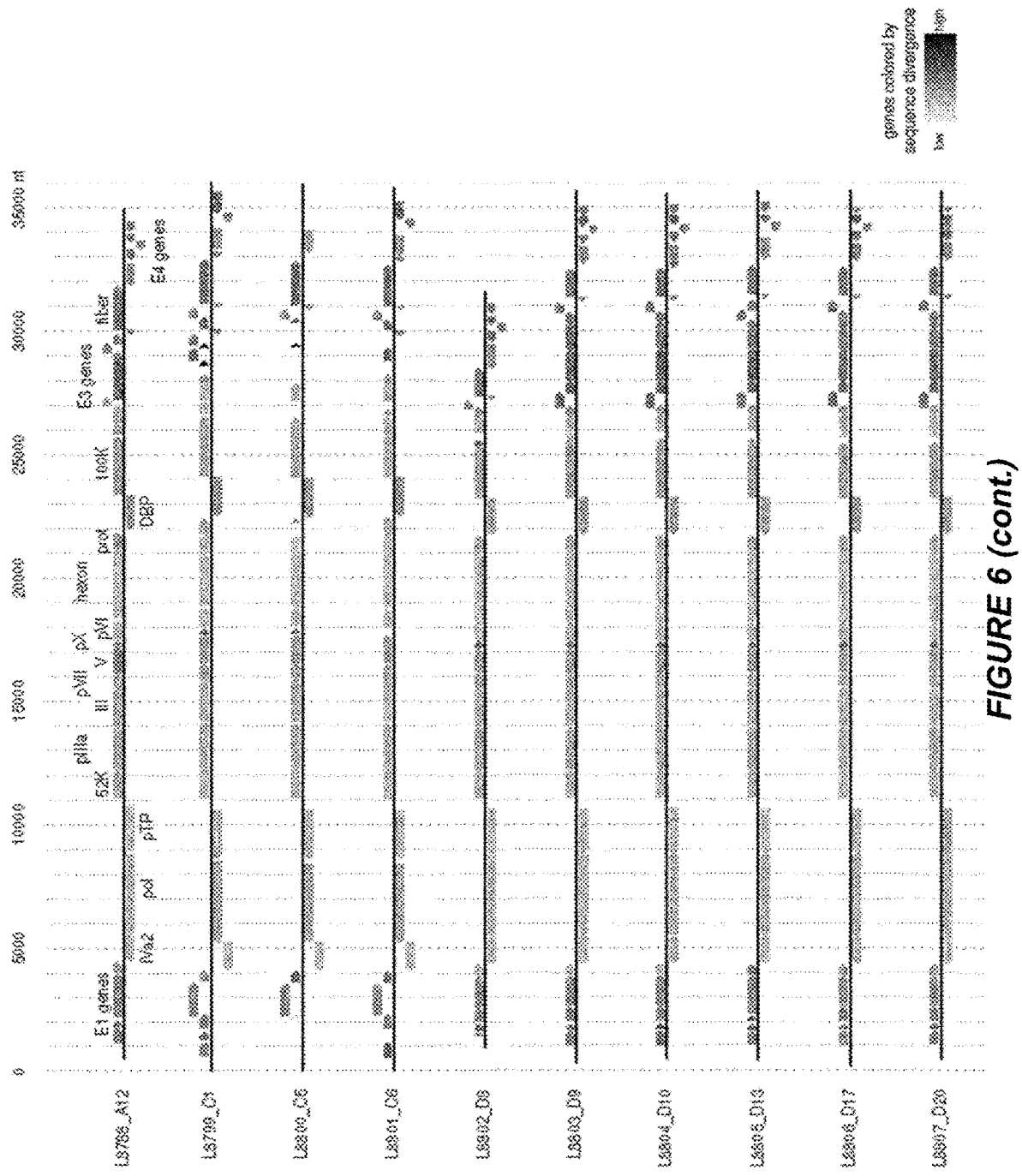
Figure 6:
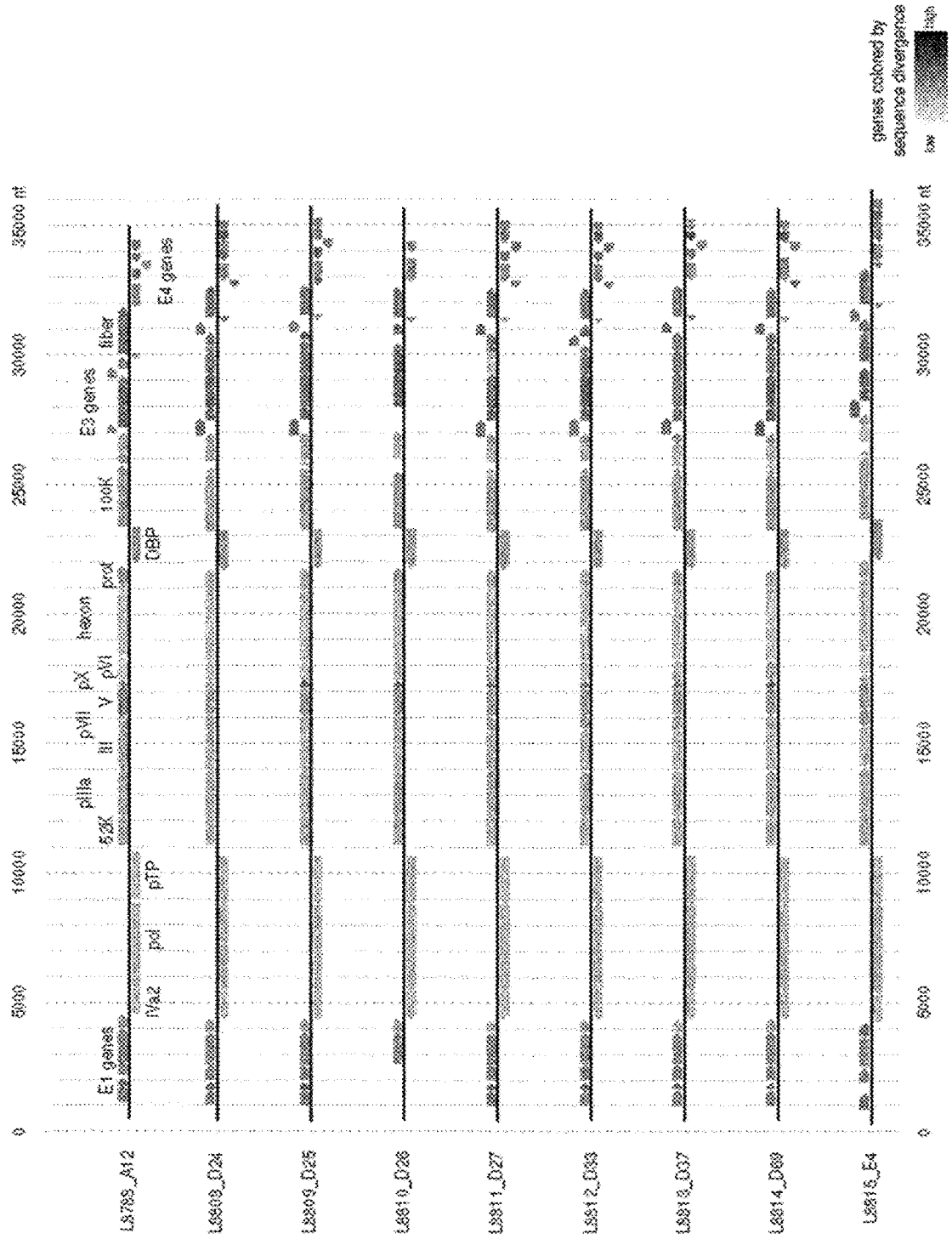

FIG. 6—Genome organisation of cloned adenoviruses

Figure 7:
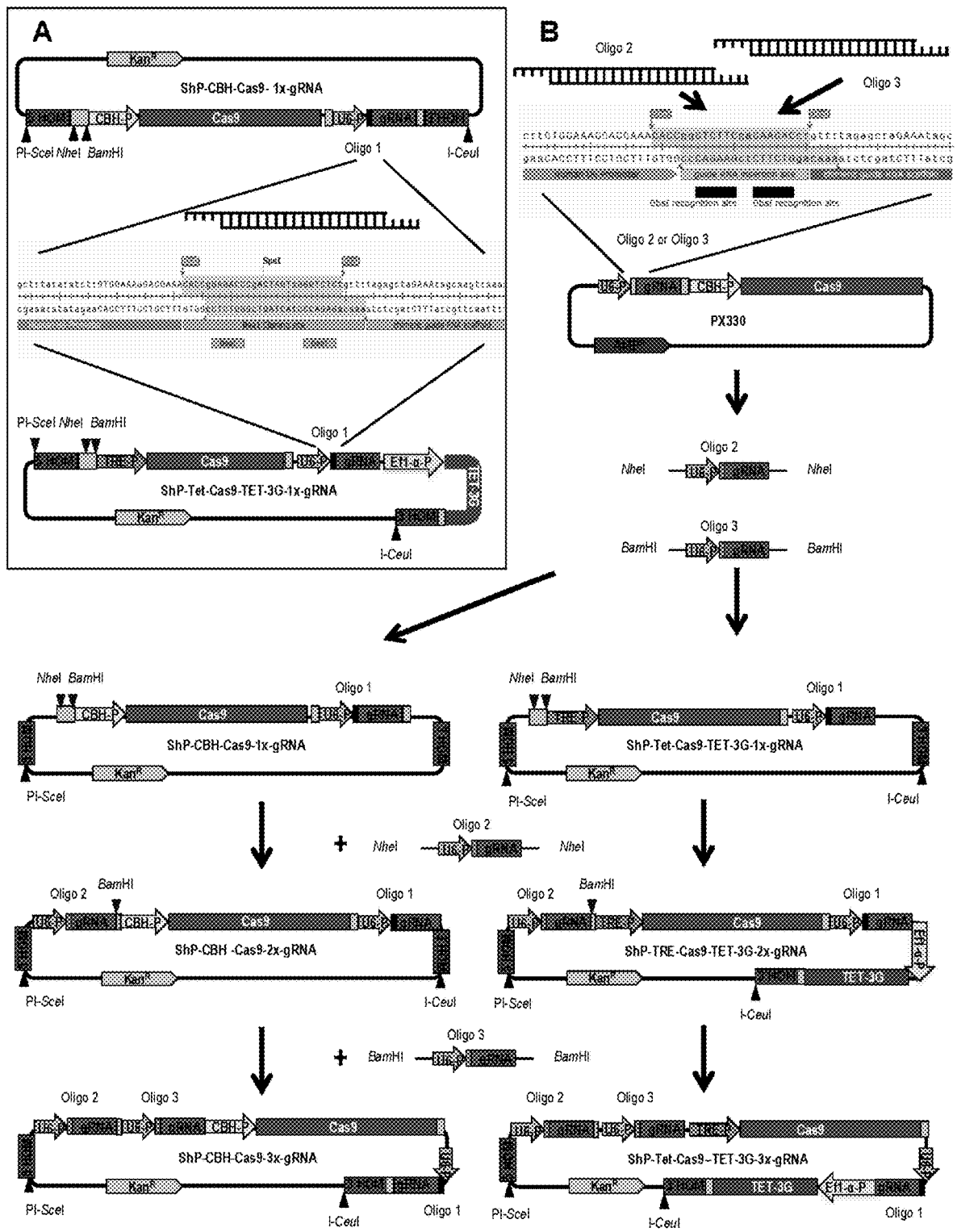

FIG. 7—HCAdV-CRISPR/Cas9 pipeline (1)

Cloning of three guide RNAs and the Cas9 coding sequence expressed under the control of a constitutive or an inducible promotor into the shuttle vector. Partial sequences used in cloning are shown in (A) (SEQ ID NOs: 1448 and 1449) and (B) (SEQ ID NOs: 1450 and 1451).

Figure 8:
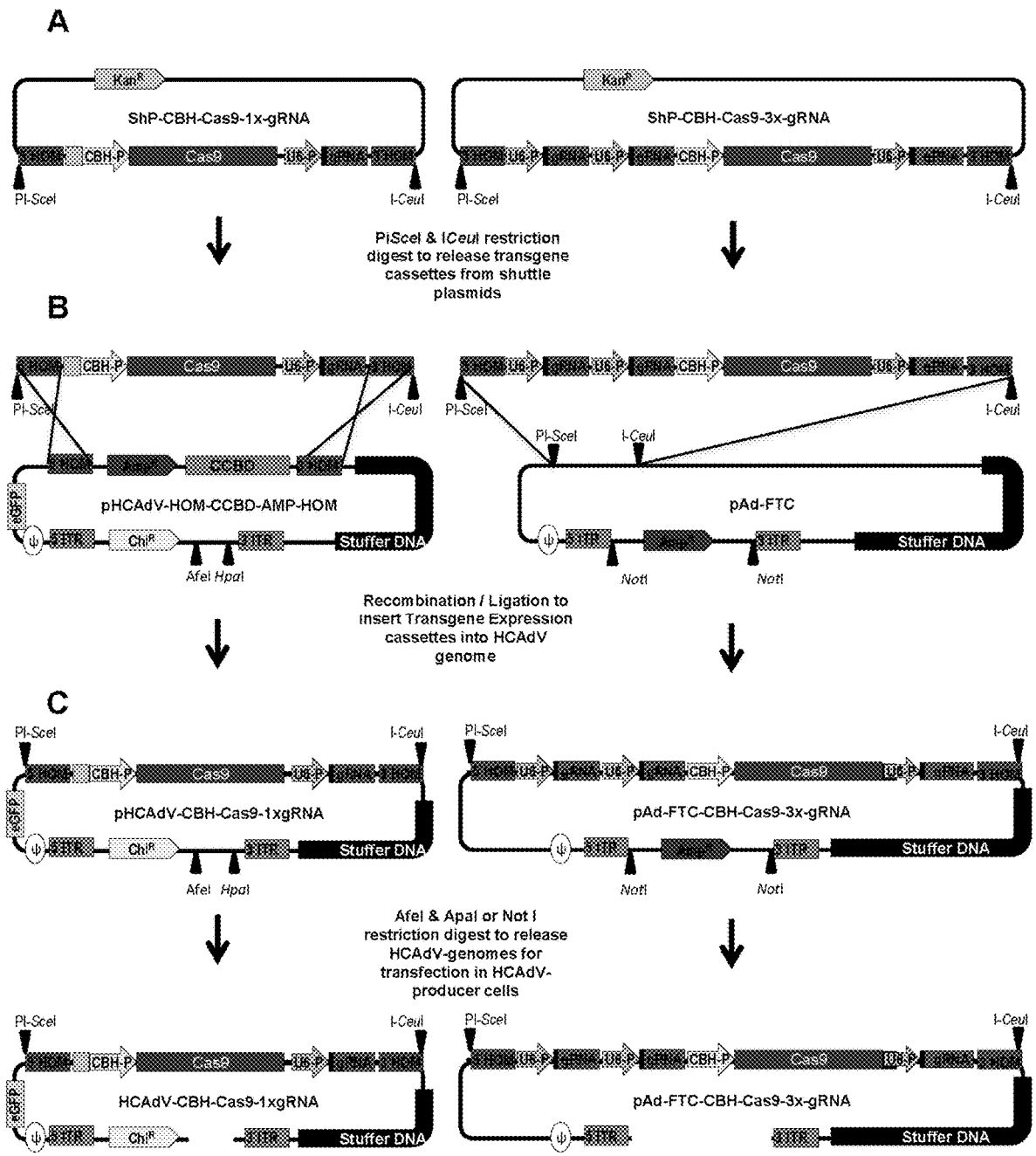

FIG. 8—HCAdV-CRISPR/Cas9 pipeline (2)

Cloning of three guide RNAs and the Cas9 coding sequence expressed under the control of a constitutive or an inducible promotor into the high-capacity adenoviral vector.

Figure 9:
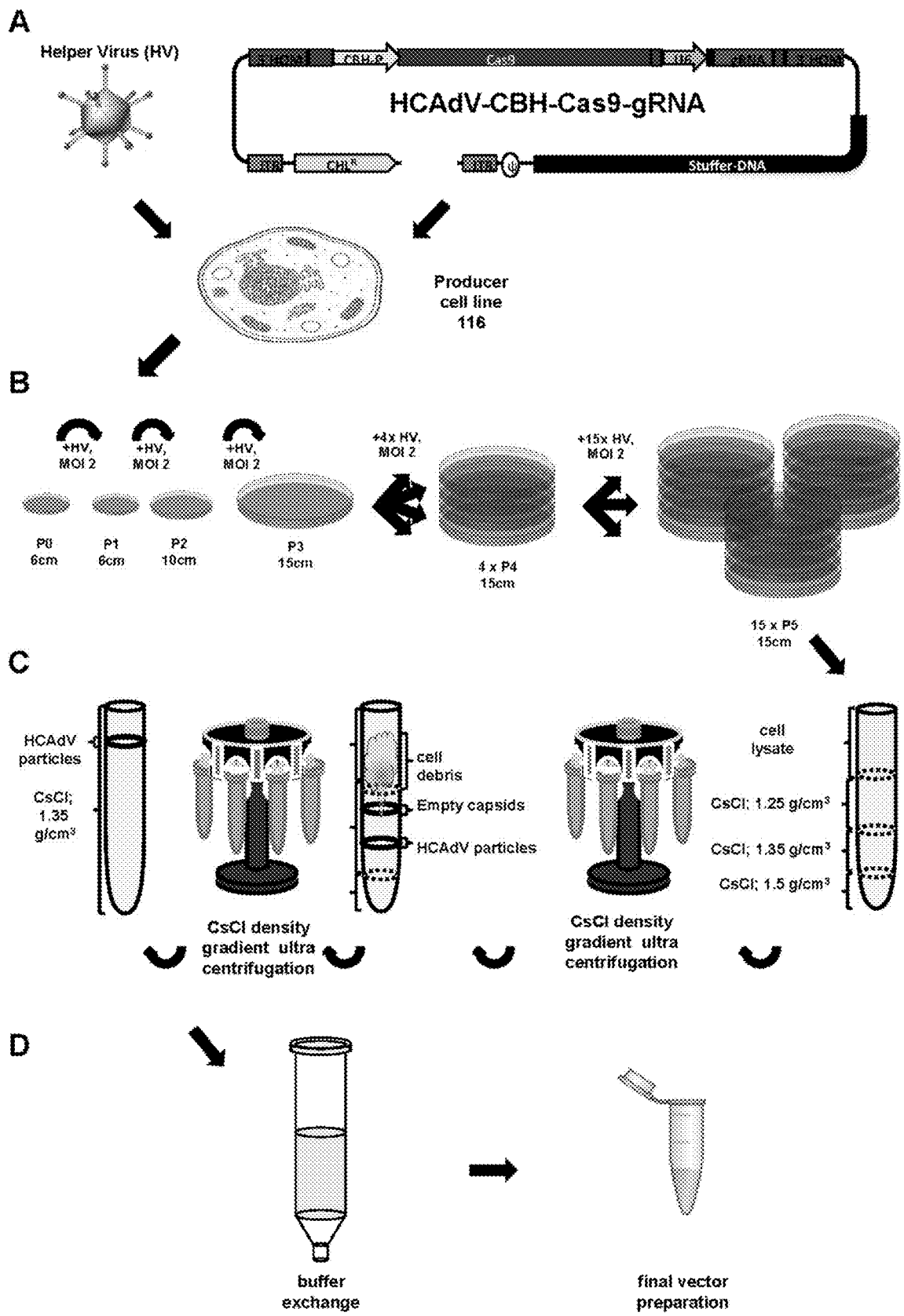

FIG. 9—HCAdV-CRISPR/Cas9 pipeline (3)

Production of high-capacity adenoviral vectors containing the CRISPR/Cas9 machinery.

Figure 10:
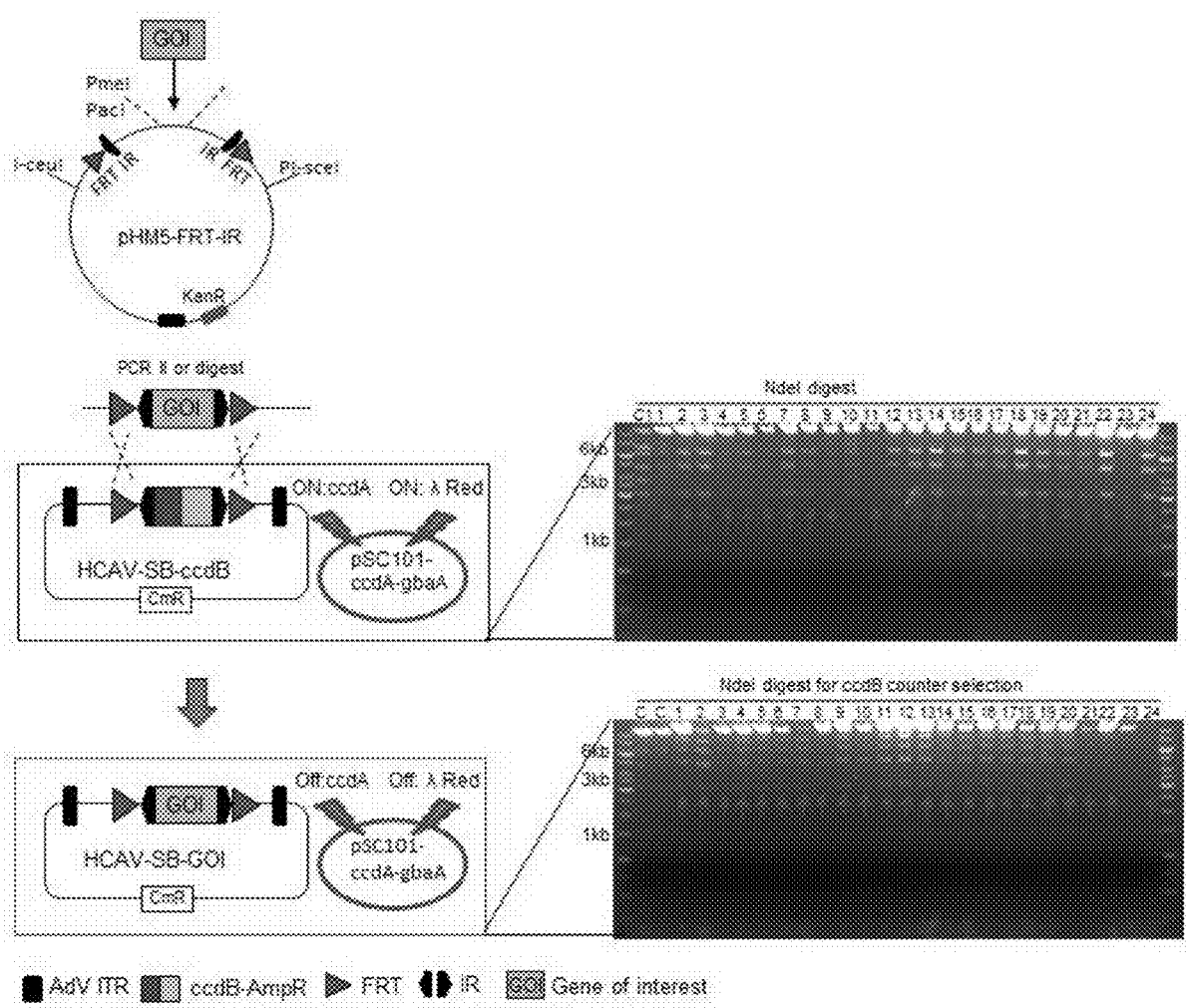

FIG. 10—Recombineering pipeline for construction of adenovirus-Sleeping Beauty transposon hybrid vectors After cloning the gene of interest into the shuttle vector pHM5-FRT-IR it can be transferred to the high-capacity adenoviral vector by recombineering.

Figure 11:
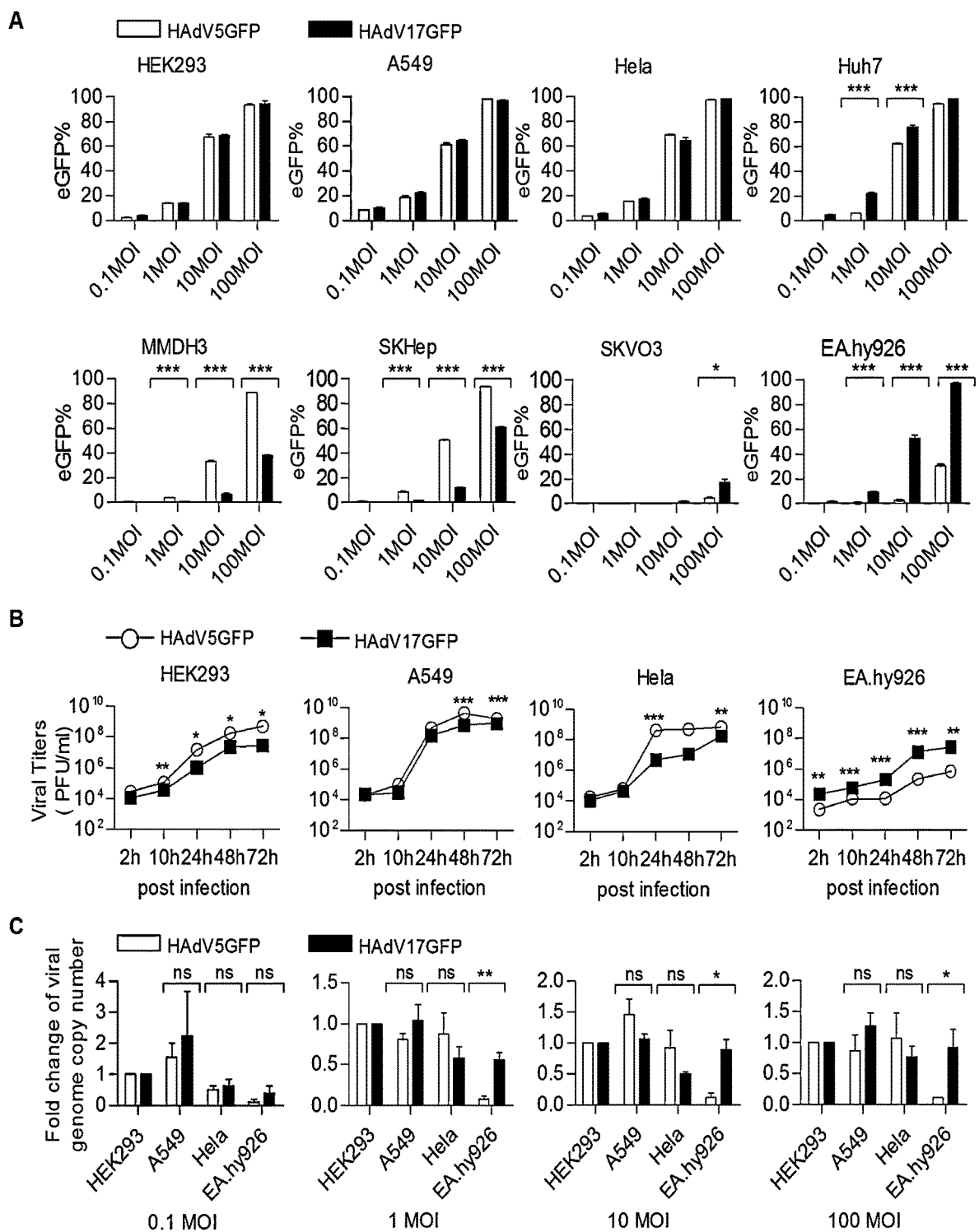

FIG. 11—HAdV17 has tropism for endothelial cells in vitro

A. Cell line screening in vitro. HEK293, A549, Hela, Huh7, Jurkat, MMDH3, SKHep, SKOV3 and EA.hy926 cells were seeded in 24 well plates the day before infection. When 90% confluent, cells were transduced with HAdV5GFP and HAdV17GFP at various multiplicities of infection (0.1, 1, 10 or 100 per cell) for 2 h. GFP expression was analysed 24 h post-infection by FACS. Uninfected cells (negative controls) were used to set the background gate at approximately 1%. Percentages of GFP-positive cells are given.

B. Growth curve comparison between wild type HAdV17 and HAdV5. HEK293, A549, Hela and EA.hy926 were seeded in 24 well plates the day before infection. When 80% confluent, cells were transduced with wild type HAdV5 and HAdV17 at a multiplicity of infection (MOI) of 10. Cells were harvested at various time points (2, 10, 24, 48, 72 hours), and quantitative PCR was performed after cellular DNA isolation to detect assay for virus replication.

C. Virus internalization analysis by quantitative PCR. HEK293, A549, Hela and EA.hy926 were infected at MOIs of 0.1, 1, 10, 100 of HAdV5GFP and HAdV17GFP in 24 well plates for 2 h. Afterwards cells were treated with 5% trypsin for 3 min, centrifuged at 500 g for 3 min and washed twice with DPBS to ensure that only internalised viral particles were analysed. Total cellular DNA (including the adenoviral DNA) was extracted, and quantitative real-time PCR was performed to detect viral genome. Data points represent mean standard error based on three independent experiments (n=3).

FIG. 12—Transduction of primary human umbilical vein cells (HUVEC)

Transduction of primary human umbilical vein cells (HUVEC). Primary HUVECs were transduced with HAdV5GFP and HAdV17GFP at various multiplicities of infection (0.1, 1, 10 or 100 per cell) for 2 hours. (A) GFP-positive cell numbers and (B) mean fluorescent intensity were analysed 24 h post-infection by FACS. Uninfected cells (negative controls) were used to set the background gate at approximately 1%. (C) Histograms show the surface markers hCAR on HEK293, HeLa, EA.hy926 and HUVEC by flow cytometry. (D) Quantitation of mean fluorescent intensity of CAR expression on cell surfaces. HeLa, EA.hy926 and HUVEC cells were stained with an anti-CAR antibody labelled with FITC and measured by flow cytometry. As negative controls each cell line was also incubated without supplementation of the primary antibody. Data points represent mean standard error (n=3).

Figure 13:
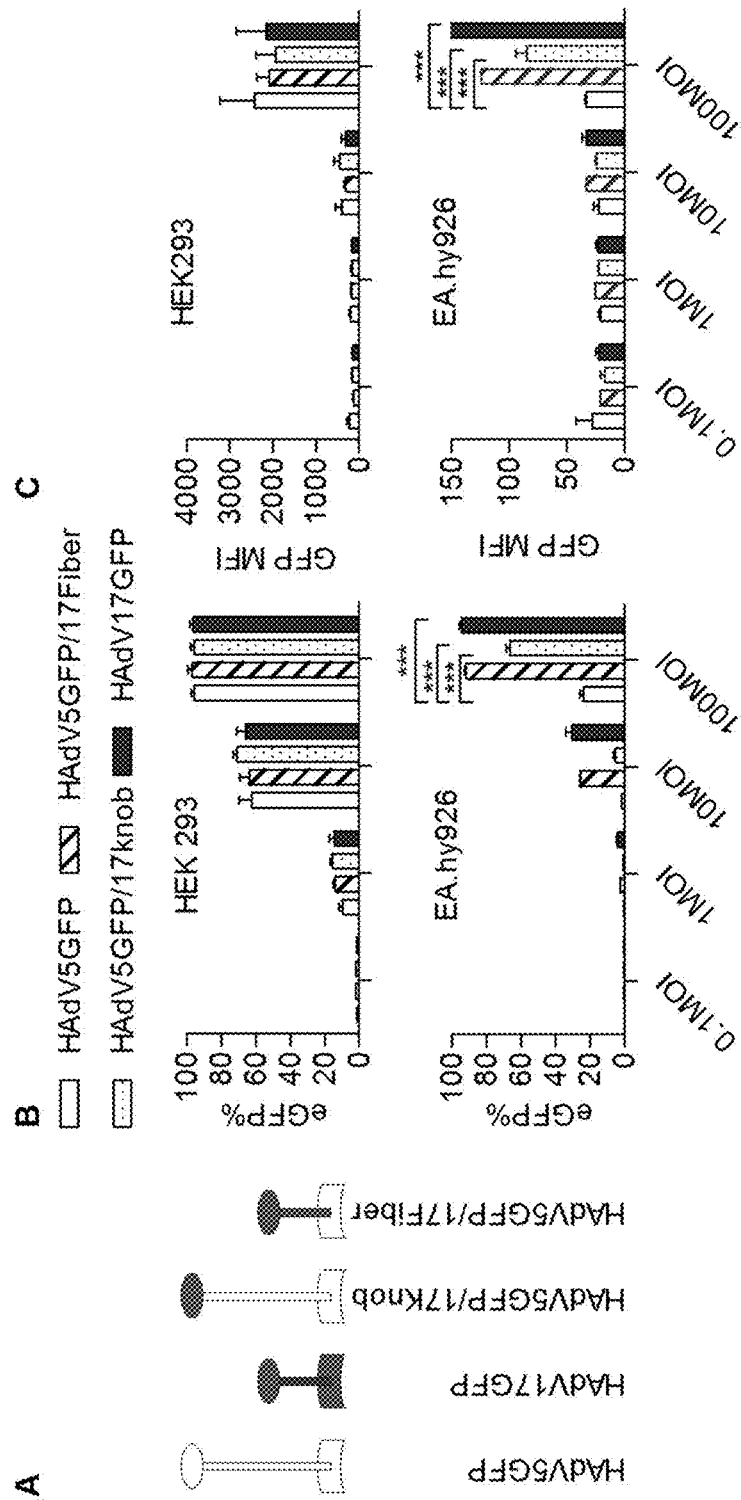

FIG. 13—Validation of endothelium tropism that is dependent on interaction between CD46 and HAdV17 fiber by gain of function study (A) Schematic representation of chimeric fiber proteins incorporated into HAdV5 capsid and structure of chimeric fiber genes (knob, shaft and tail). White depicts the fiber derived from HAdV5GFP and black depicts the fiber derived from HAdV17GFP. HAdV5GFP/17knob contained the shaft and tail from HAdV5 and knob from HAdV17. HAdV5GFP/17 fiber contained the tail from HAdV5 and both shaft and knob from HAdV17. (B) HEK293 and EA.hy926 cells were seeded in 24 well plates the day before infection. When 90% confluent, cells were transduced with HAdV5GFP, HAdV5GFP/17fiber, HAdV5GFP/17Knob and HAdV17GFP at various multiplicities of infection of (0.1, 1, 10 or 100 per cell) for 2 h. GFP expression was analysed 24 h post-infection by FACS. Uninfected cells (negative controls) were used to set the background gate at approximately 1%. Percentages indicate percentage of GFP-positive cells. MFI=mean fluorescent intensity. Data points represent mean standard error (n=3).

Figure 14:
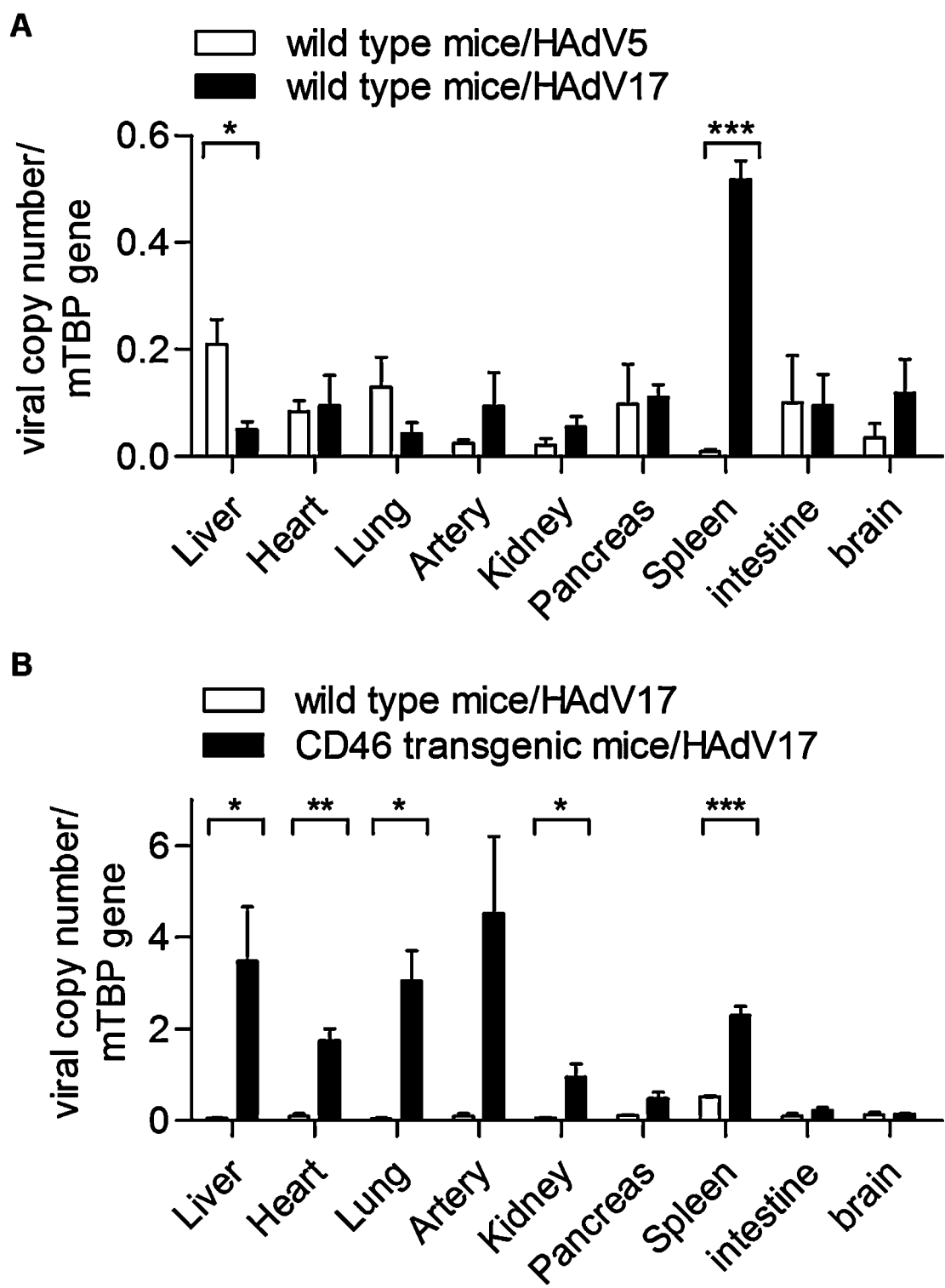

FIG. 14—in vivo biodistribution of HAdV17GFP vectors

Viral genomes were detected by real-time quantitative PCR in various organs (liver, heart, lung, artery, kidney, pancreas, spleen, intestine and brain) harvested 72 hrs after systemic administration of $2\times10^9$ transducing units per mouse of HAdV17GFP into both CD46 transgenic mice and wild-type mice. HAdV5GFP was administered to wild-type mice as a control (n=3 mice per group).

Figure 15:
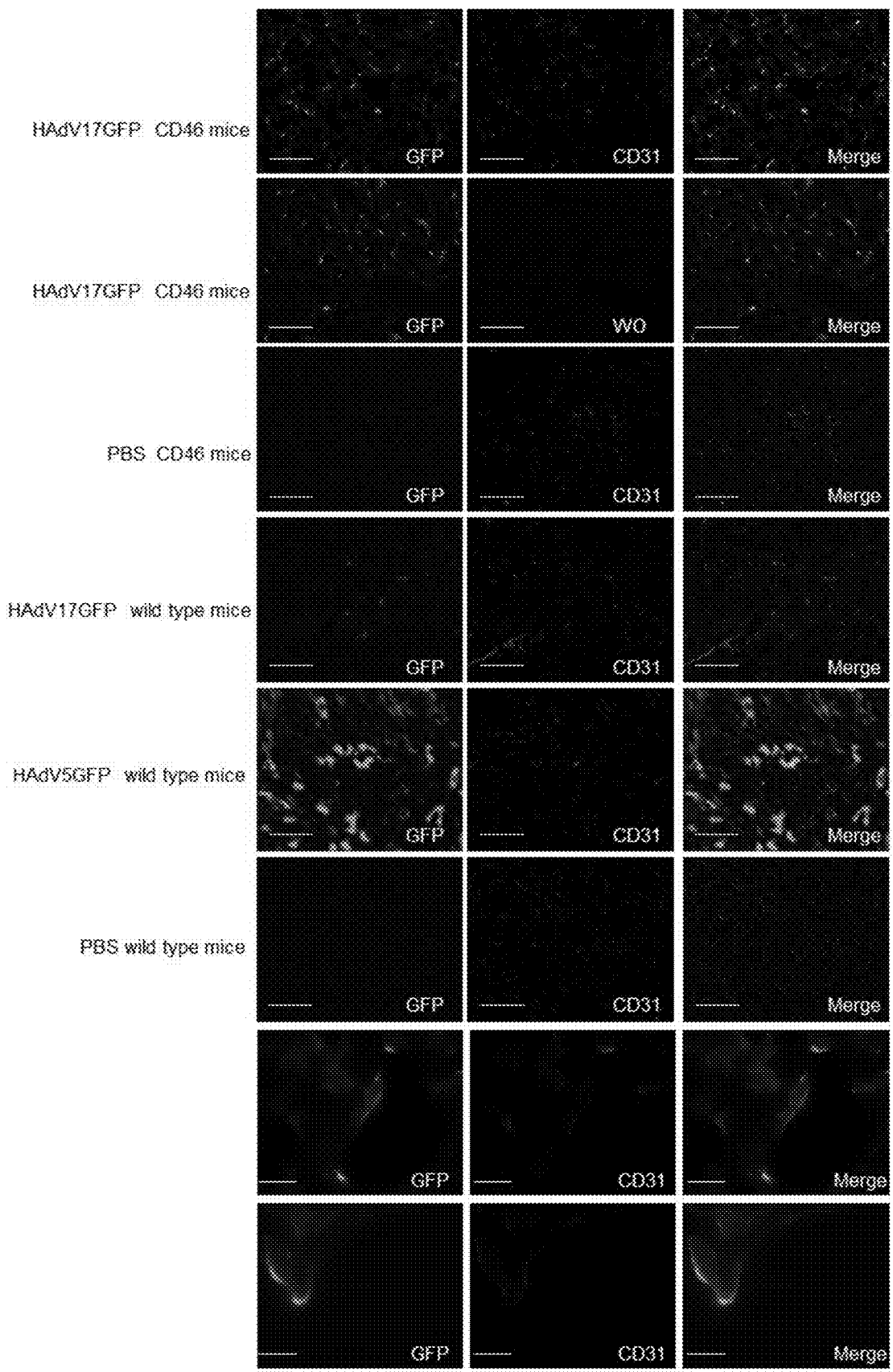

FIG. 15—Immunofluorescence analysis of liver sections

Mice were sacrificed at 3 days after vector injection, and livers were excised for histology. (A) The top panel shows colocalisation of viral transgene (GFP) expression (green) with endothelial markers (CD31, red) from CD46 transgenic mice injected with HAdV17GFP. Single stained and merged images at 20× magnification are presented. The scale bar of images is 100 μm.

The $4^{th}$ panel from the top is from wild type mice injected with HAdV17GFP. The $5^{th}$ panel from the top is from wild type mice injected with HAdV5GFP. PBS treated transgenic mice ($3^{rd}$ panel from the top) and PBS treated wild type mice ($6^{th}$ panel from the top) are controls. The $2^{nd}$ panel from the top is from CD46 transgenic mice injected with HAdV17GFP without CD31 primary antibody treatment. (B) The $7^{th}$ and $8^{1h}$ panels from the top are views at a higher magnification (60×) of the first panel. Images are representative of multiple fields of view. The scale bar of images is 25 μm.

Figure 16:
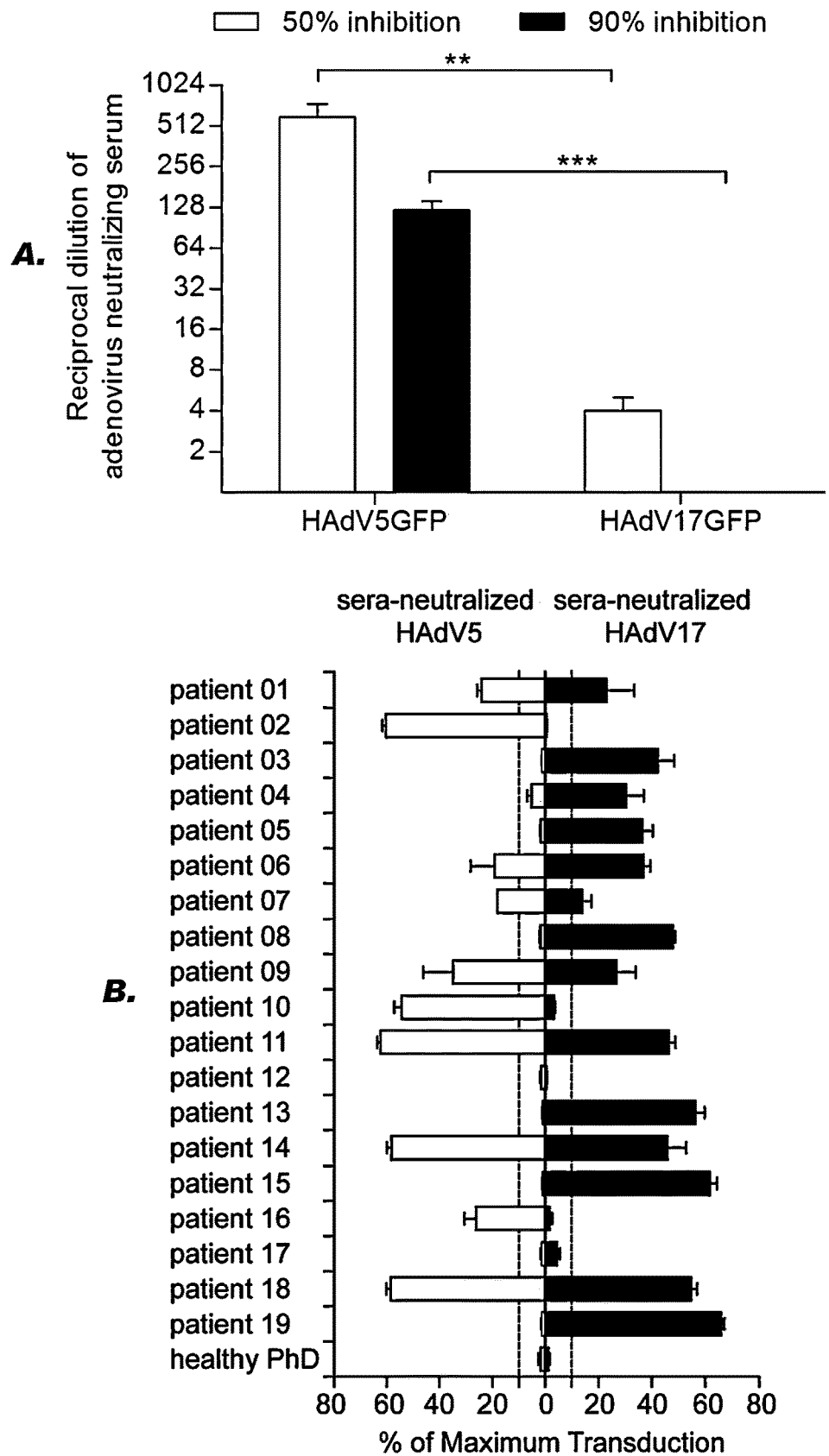

FIG. 16—Neutralising antibody assay for HadV17

(A) Reciprocal dilution of dog serum, immunised with HAdV-5, was incubated with HAdV17GFP and HAdV5GFP. The serum-virus mixture was used to infect HEK293 cells and 24 hours post-infection, GFP expression levels were determined. (B) Preexisting immunity to HAdV17 in patients. Transduction assays were carried out in the presence of serum samples from 19 patients. Samples were considered neutralising if greater than 90% reduction in transduction (below 10% residual transduction) was seen in comparison to a no-serum control.

Figure 17:
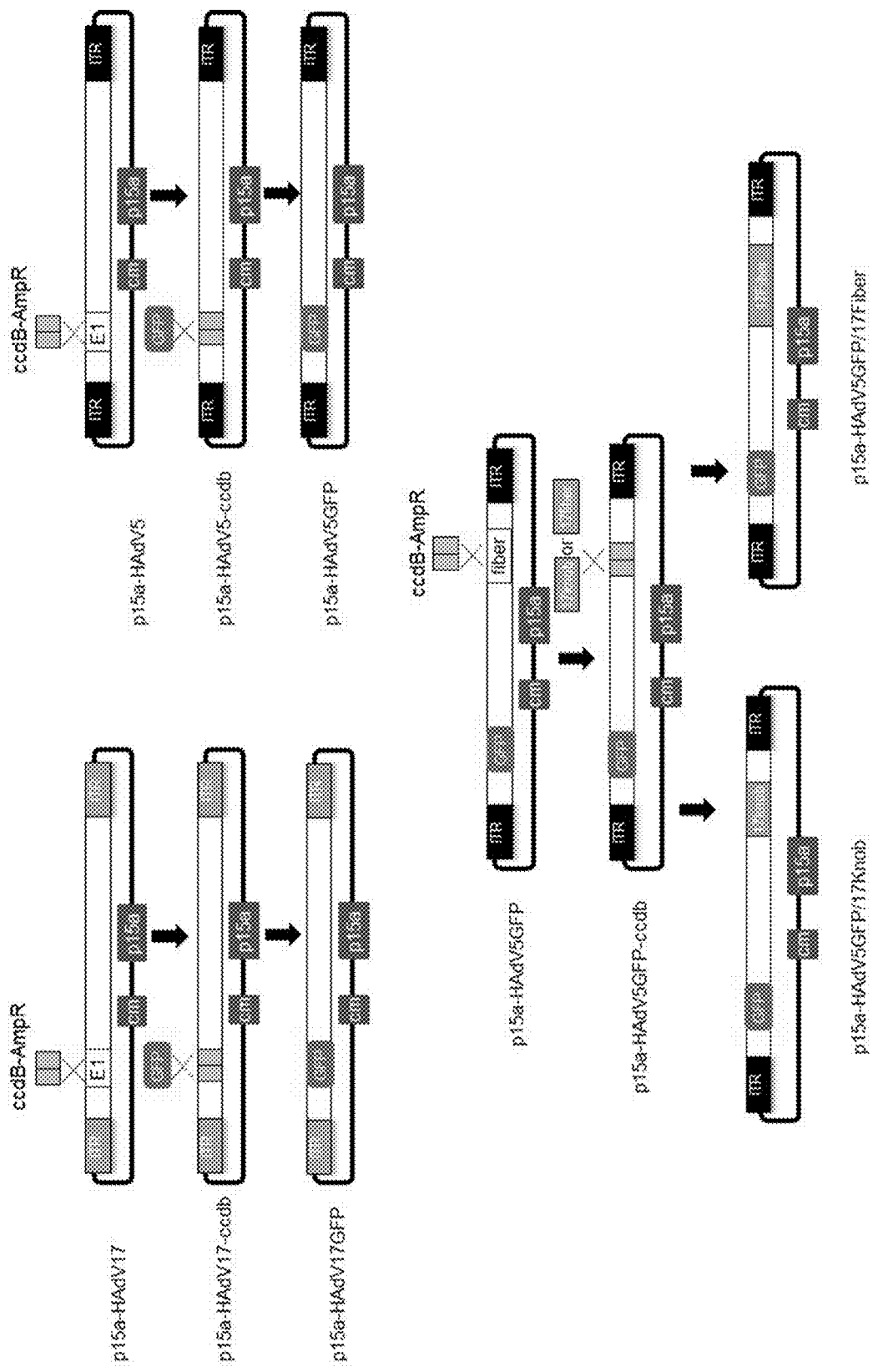

FIG. 17—Schematic structure of different virus vectors used in Example 3

(A) Diagram of ccdB recombineering to construct first generation p15a-HAdV17GFP. (B) Schematic structure of pseudotyping HAdV5GFP with knob or fiber from HAdV17.

Figure 18A:
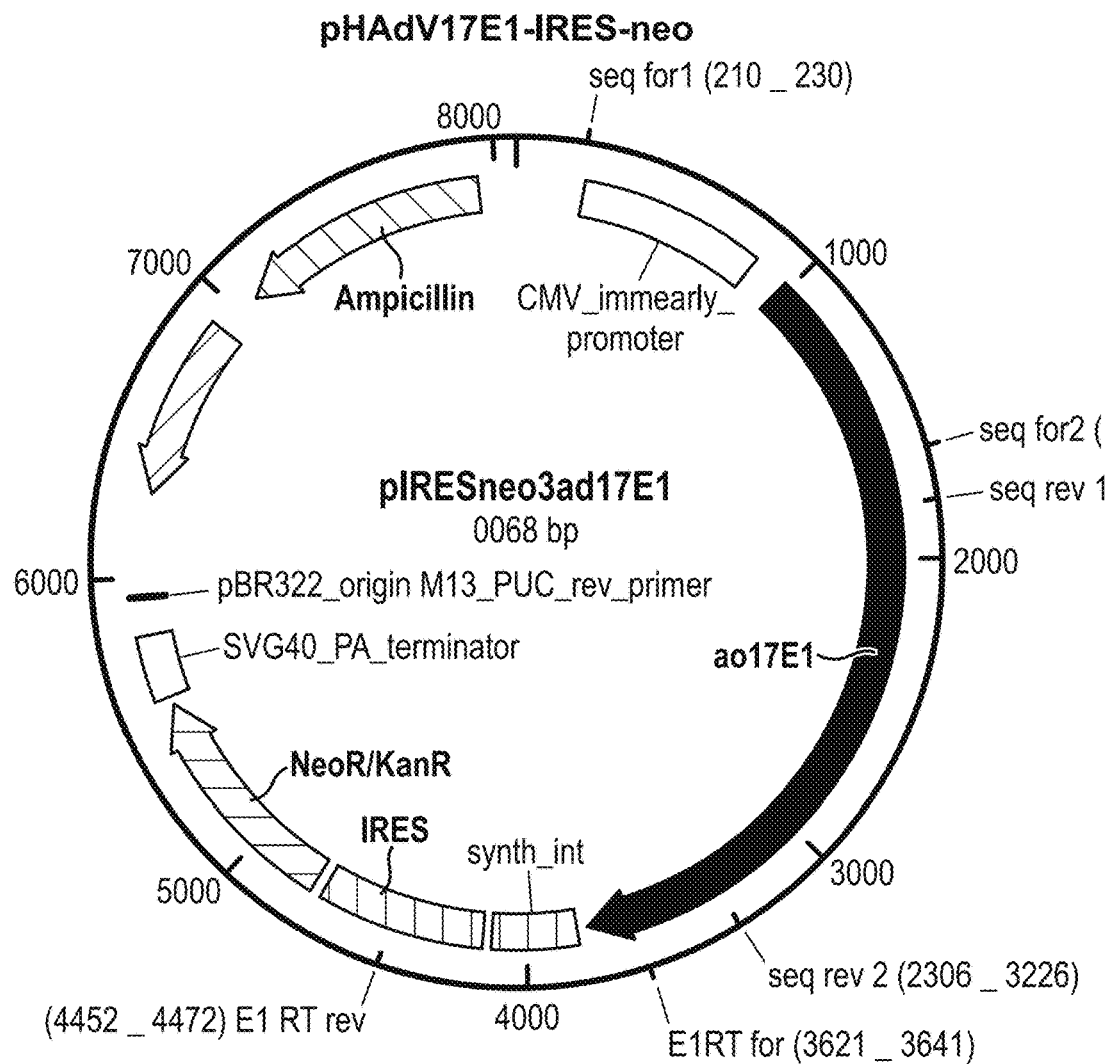
Figure 18B:
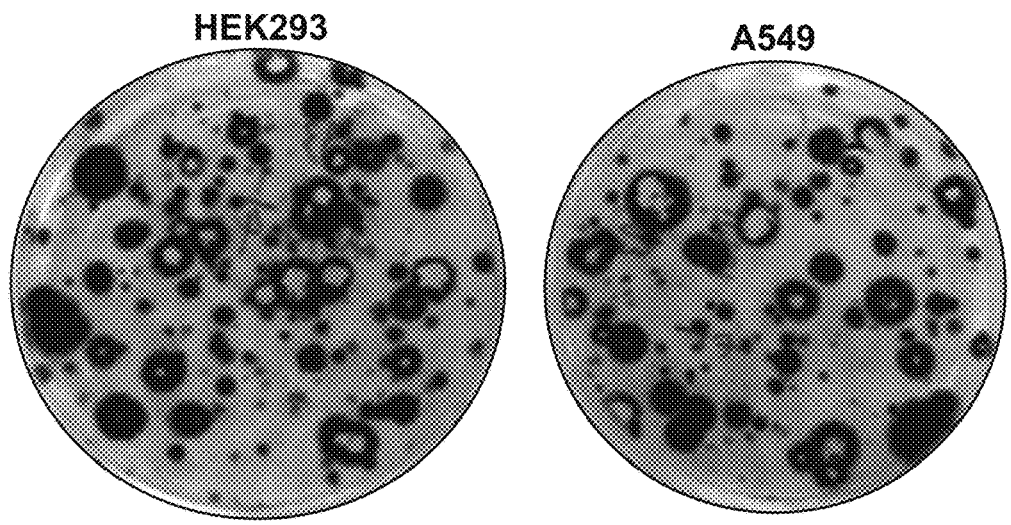

FIG. 18—Generating stable complementing cell lines based on HEK293 and A549 cells using the plasmid pIRES-neo (A) E1 cassette from HAdV17 (2808 bp) was amplified by PCR and ligated into multi cloning site of pIRESneo3 (clontech) to construct the vector pCMV-HAdV17E1-IRES-neo. (B) Methylene blue staining was performed to mark the positive cell clones. (C) PCR and RT-PCR were performed to analyse each cell clone. Genomic DNA was isolated from each cell clone and eluted in $dH_2O$. Total RNA was isolated and resuspended in RNase-free H2O. Reverse transcription was performed, and 5 μl of the cDNA was used for PCR. A negative control without reverse transcriptase was performed.

FIG. 19—Histograms show the surface markers of hCAR and CD46 expression level in various cell lines by flow cytometry $0.5\times10^6$ cells (HEK293, A549, HeLa, EA.hy926, MMDH3 and HCT116) were counted and washed with PBS supplemented with 1% BSA, centrifuged (1500 g, 3 min), and resuspended in 100 μl PBS/BSA and 2.5 μl anti-hCAR antibody (Santa Cruz, sc-56892) following an incubation step at 4° C. for 1 hour. Afterwards the cells were washed again with PBS/BSA to remove unbound antibody, resuspended in 100 μl PBS/BSA and 0.5 μl of an APC labeled goat anti-mouse secondary antibody (Santa Cruz, sc-3818), and incubated for 1.5 hours at 4° C. with continuous shaking. Afterwards cells were again washed with PBS/BSA and finally resuspended in 400 μl PBS for flow cytometry using FACS (BD). As negative controls each cell line was also incubated without supplementation of the primary antibody. Data points represent mean standard error (n=3).

Figure 20:
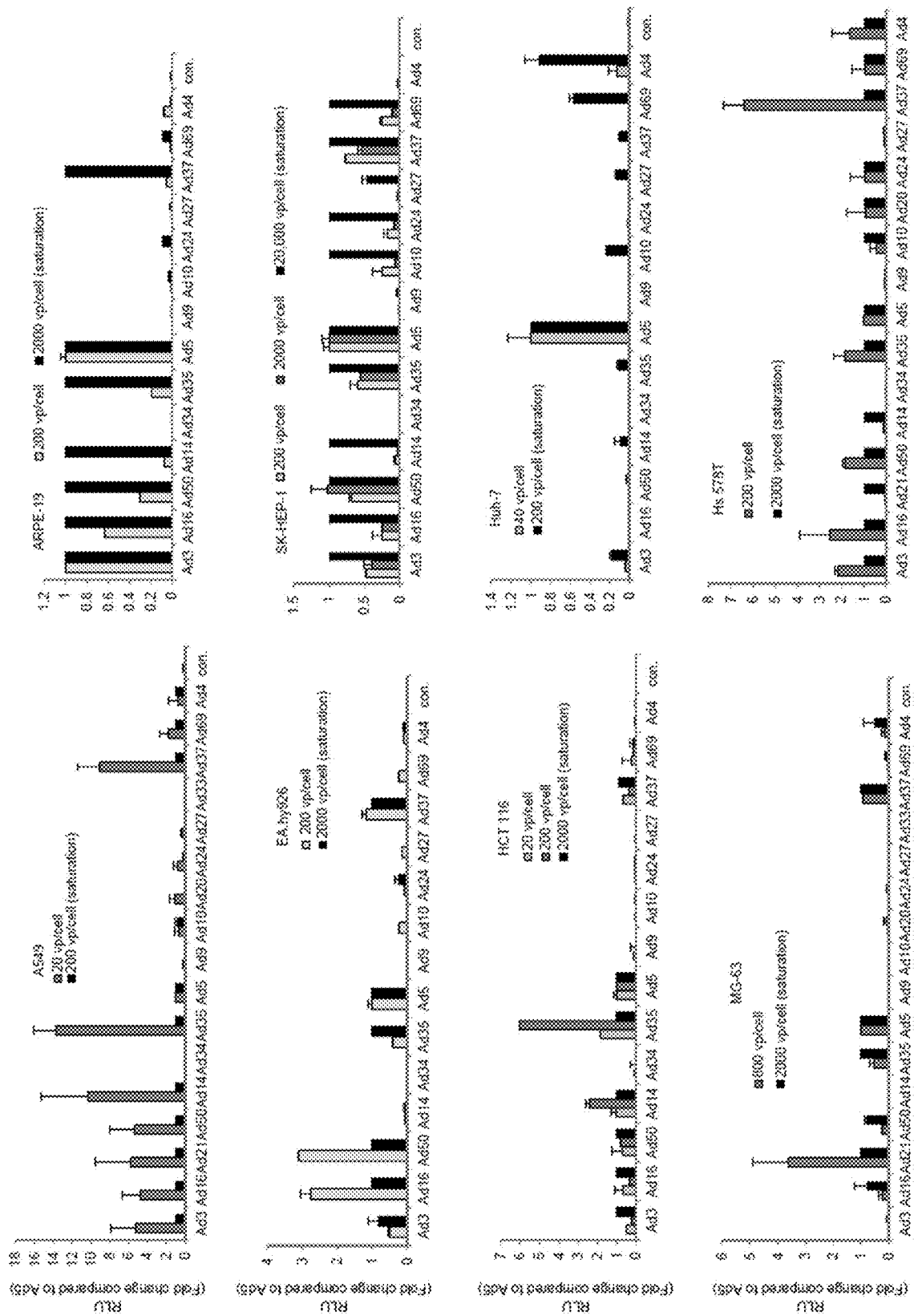

FIG. 20—High-throughput screening (HTS) of the reporter-tagged human adenovirus library in a panel of human tumour cells Transgene expression efficiency of different adenovirus types (Ad type number) was tested in a panel of disease-specific cell lines. Levels were compared to the commonly used adenovirus type 5 (Ad5) and indicated as fold change. Luciferase expression was measured by addition of Furimazine substrate and expressed as relative light units (RLU). In all cell lines error bars represent mean±SD with the exception that in A549 and MG-63 is mean±SEM.

Figure 21:
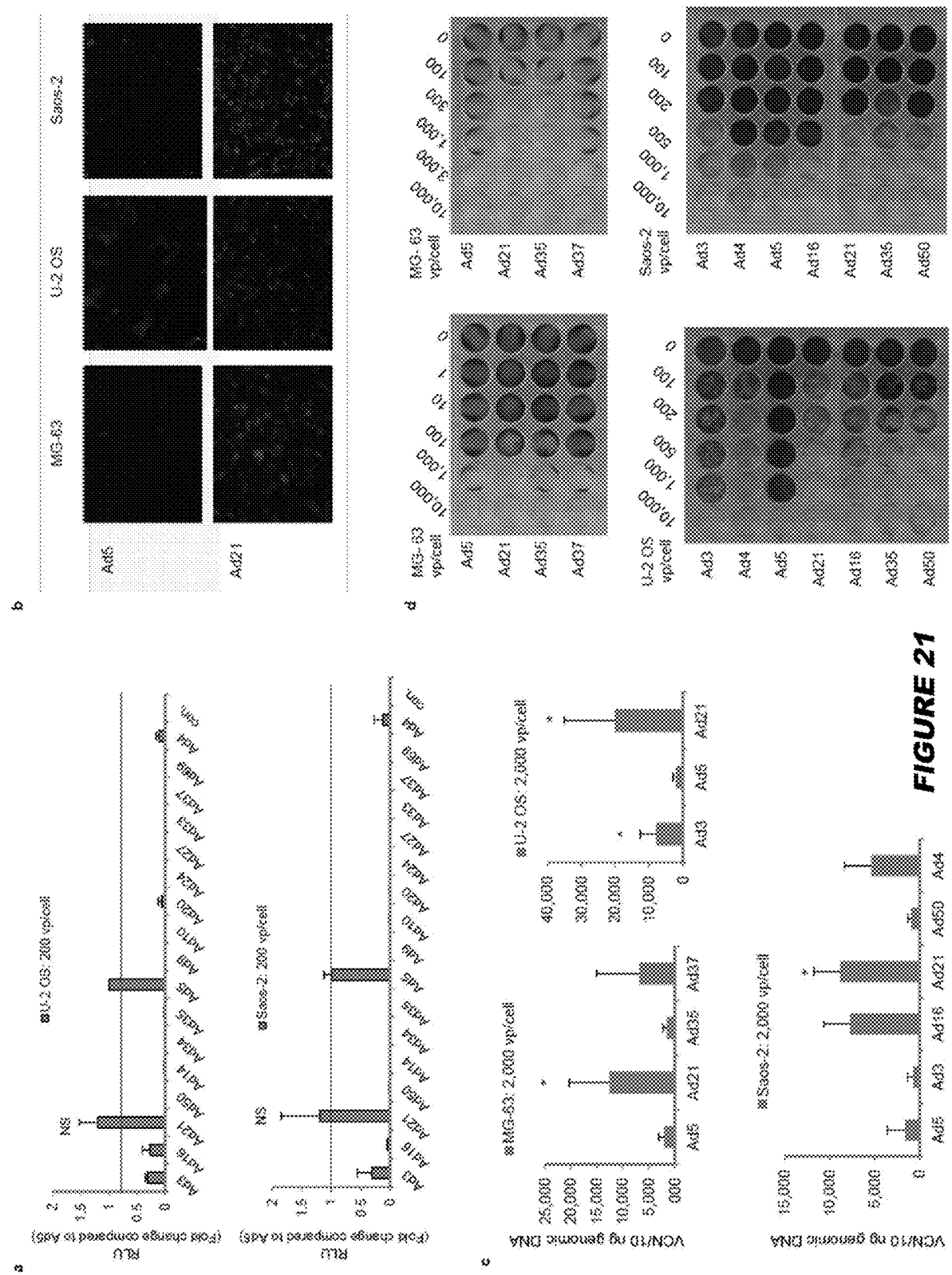

FIG. 21—High-throughput screening (HTS) to identify virus candidates with high oncolytic potency in osteosarcoma cells (A) Transduction of two osteosarcoma cell lines. 200 vp/cell were applied with three independent experiments performed. Error bars denote s.e.m. Data were analysed by two-tailed unpaired t-test. P-values for analysed virus types compared to Ad5 were <0.05 if not otherwise stated. NS, not significant; vp, viral particles.
(B) Virus internalization efficiency in three osteosarcoma cell lines. Cells were infected with individual viruses at 2,000 vp/cell for three hours to determine viral genome copy numbers (VCN), which were quantified by qPCR and expressed as VCN per 10 ng total DNA. Error bars represent mean±SD. n=3 per group. Data were analysed by two-tailed unpaired t-test. P-values for analysed virus types compared to Ad5 were >0.05 if not otherwise stated. *, significant (p<0.05).
(C) Visualization of GFP-expression 2 days post infection. Cells were infected at 1,000 viral particle (vp) per cell.
(D) Crystal violet staining of viable cells was used to evaluate oncolytic activity 7 days after infection.

Figure 22:
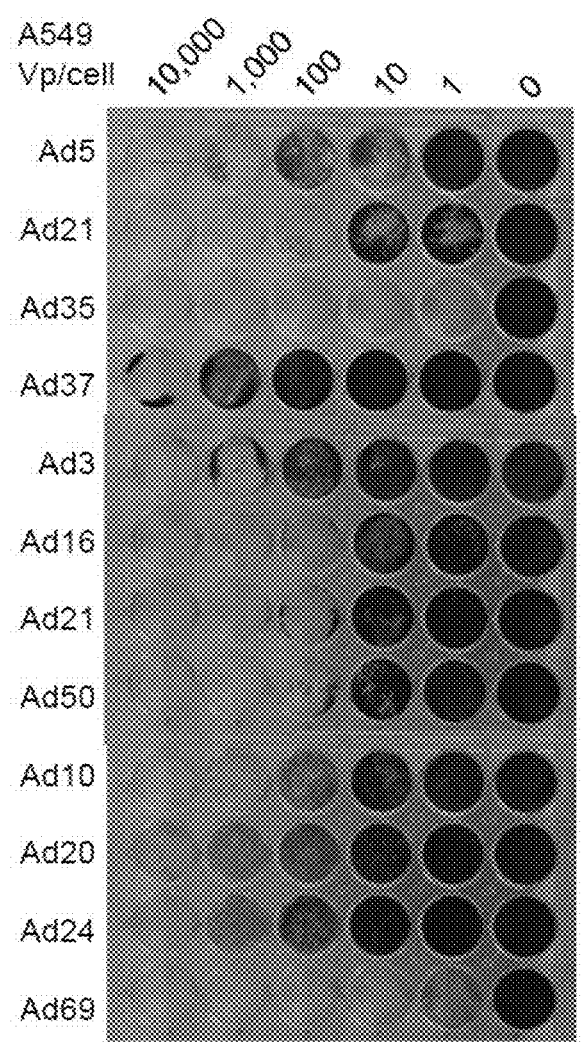

FIG. 22—High-throughput screening (HTS) to identify virus candidates with high oncolytic potency Oncolysis assay performed in A549 cells as oncolytic assay control. Crystal violet staining of viable cells was used to evaluate oncolytic activity 7 days after infection.

FIG. 23—Transgene expression efficiency of different adenovirus types (Ad type number) in the cell line RG2 [D74] at 2000 virus particle per cell (vp/c)

Ad5, Ad21 and Ad37 showed high luciferase (26 hs p.i.) and GFP expression (2 ds p.i.), albeit without being significant. All three viruses reached about the same dimension of efficiency. Furthermore Ad20 reached more than 20% of the efficiency of Ad5. Luciferase expression was measured by addition of Furimazine subtract and expressed as relative light units (RLU). Transgene expression levels were compared to the commonly used adenovirus type 5 (Ad5) and indicated as fold change. Error bars represent standard error of the mean (SEM). Data were analysed by two-tailed unpaired t-test. P-values for analyzed virus types compared to Ad5 were <0.05 if not otherwise stated. "NS" means "not significant (p>=0.05)".

The invention is further described with reference to the following non-limiting examples:

EXAMPLES

Example 1—Cloning Adenoviral Genomes

Figure 1:
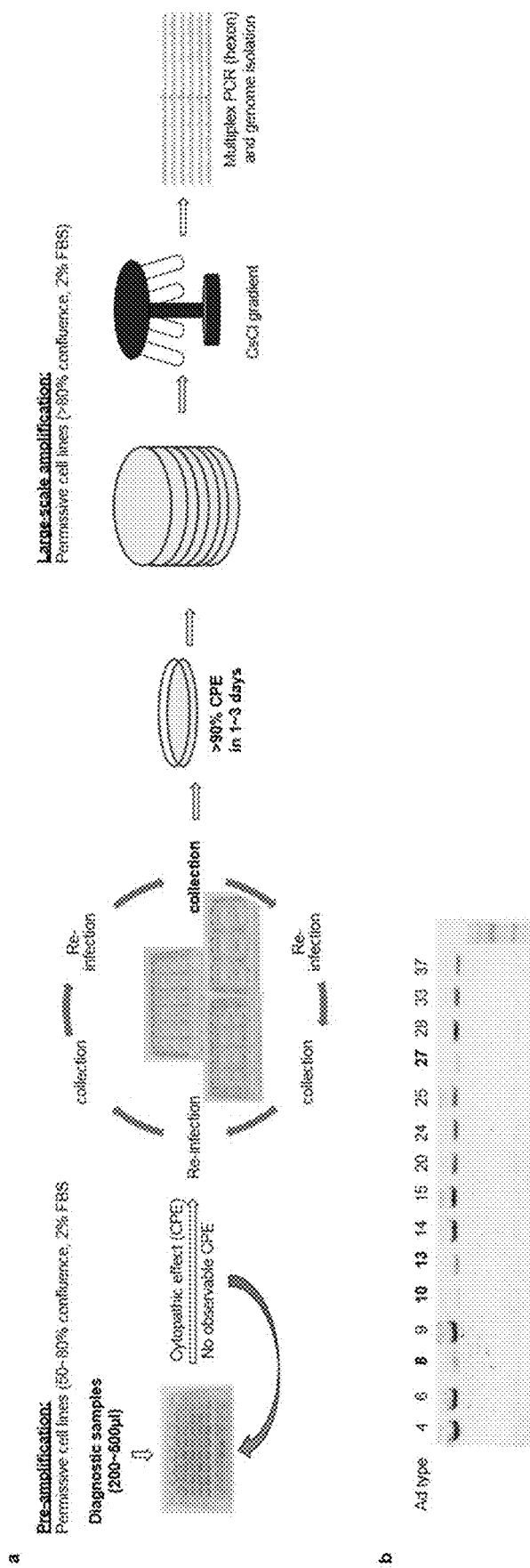
FIG. 1—Schematic outline of wild-type adenovirus amplification and viral genome isolation
a) Wild-type human adenoviruses from clinical isolation were first pre-amplified in individual permissive cell lines (50~80% confluence, 2% FBS) using repeated infection circles to achieve 90% cytopathic effect (CPE). Then each virus was amplified in a large scale manner in 10-20 15 cm tissue culture dishes. Crude cell lysates were used to purify viruses by CsCl gradients, followed by viral genome isolation and sequence verification.

Clinical isolates of wild type (WT) Ad were amplified in permissive cell lines (e.g. HeLa, HEK, A549) using serial amplification steps. After large-scale amplification Ads were purified by cesium chloride gradients (FIG. 1). To verify the Ad type a multiplex hexon-specific PCR was performed and the DNA sequence was confirmed. Viral genomes of purified Ad particles were isolated (FIG. 1) and LLHR was applied to directly clone isolated viral genomes as schematically shown in FIG. 2. We first established a fast and reliable strategy to generate master clones for direct Ad genome cloning based on annealing of 4 PCR fragments in one step. These PCR fragments with homology arms (HA) for directed cloning contained the 5' and 3' ITR sequences, the previously published selection marker ccdB10 and ampicillin for advanced positive and counter selection and the plasmid backbone with a p15A origin of replication and the chloramphenicol resistance gene (FIG. 1). Different ratios of PCR products were tested, and after homologous recombination (HR) in a RecET expressing E. coli strain this resulted into the novel medium copy plasmid p15A-cm-adHA. Equal amounts of all 4 PCR fragments resulted in highest cloning efficiency (FIG. 2b).

Next, isolated linear Ad genomes were cloned into this plasmid using LLHR. FIG. 2c shows recombineering efficiencies of direct viral genome cloning using various amounts of viral DNA (0 to 1 µg) and 1 µg of the linearised shuttle vector. The plasmid backbone for direct cloning of large dsDNA viruses containing the p15A origin of replication results in significantly increased cloning efficiencies and is easier to handle compared to commonly-used bacterial artificial chromosomes (BAC). Since numerous viral genomes show high sequence homologies in their ITR sequences, viral genomes could be cloned simultaneously using the same shuttle vector p15A-cm-adHA containing the same HA. Only 50 bp HA are required, enabling fast and reliable direct HTC. The same strategy was used for Ad from species D, B2 and C.

Integrity of all cloned Ad genomes was checked by diagnostic restriction enzyme digests and compared to originally isolated Ad genomes from virions (FIG. 2). NGS was used to determine exact sequences of all Ad containing plasmids. Extensive rescue experiments were performed and the strategy optimised by testing different molecular forms (precise excision of the Ad genome, linearised Ad containing plasmid and circular Ad genome containing plasmid) (FIG. 3). After introduction of viral DNA into Ad permissive cell lines, viral replication was monitored by quantitative PCR (qPCR) over more than 5 serial passaging steps and the precise excision of the Ad DNA molecule from the plasmid was most sufficient in rescuing Ad. This strategy was then applied to all cloned human Ad.

To further explore the cloned human Ad library, viral genomes were tagged with a 2A peptide-mediated multicistronic-expression cassette (GLN, SEQ ID NO:227) providing a TurboGFP fluorescent protein as an in vitro marker, a NanoLuc luciferase for in vivo studies and kanamycin/neomycin as a selection marker. As schematically outlined in FIG. 3, LCHR was applied for marker insertion into the early gene E3 region of the cloned Ad genomes of the library. In a first step, spectomycin acetyltransferase was inserted via HR in E. coli strain GB05-Red into the adenoviral genome, followed by GLN cloning. By using a conserved region in the E3 region, different Ad genomes could be tagged in a high-throughput manner using the identical shuttle vector for different Ad types (FIG. 4). Tagged Ads were rescued in permissive cell lines.

Tagging of Ad enabled in vitro and in vivo characterisation of chosen Ad types. After infection of cell lines originating from different cell types derived from different organs (epithelium, endothelium, muscle, blood, liver) and measurement of luciferase and GFP expression it was found that tagged Ad show a distinct tropism (FIG. 3). The in vivo tropism was analysed by systemically injected tagged HAdV-B3, HAdV-616, HAdV-650, HAdV-05, and HAdV-E4 into 057Bl/6 mice. As shown in FIG. 3, viruses also showed a distinct biodistribution as detected by transgene expression levels and viral genome level. A summary of the complete pipeline to study natural Ad diversity and to generate an engineered Ad library including tagging of viral genomes is shown in FIG. 5.

Methods for Example 1 and Other Examples

Cell Culture—

Human Hela cells, A549 cells, HEK293, and EA.hy926 cells were grown in high glucose Dulbecco's Modified Eagle's Medium (DMEM, PAN BIOTECH) supplemented with 10% FBS (GE Healthcare), 100 U ml-1 penicillin (PAN-BIOTECH), and 100 µg ml-1 streptomycin (PAN BIOTECH). For human hepatocyte Huh7, Non-Essential Amino Acid (NEAA) was added. For Jurkat cells, RPMI-1640 based Medium supplemented with 10% FBS, 100 U ml-1 penicillin and 100 µg ml-1 streptomycin was used. For the murine cell line Neuro2a (N2a) cells, Eagle's Minimum Essential Medium (EMEM, GE Healthcare), supplemented with 10% FBS, 100 U ml-1 penicillin and 100 µg ml-1 streptomycin was used. For the murine myoblast C2C12 cells, DMEM supplemented with 10% FBS, 100 U ml-1 penicillin and 100 µg ml-1 streptomycin was used.

Wild Type Adenoviruses—

HAdV-05 (ATCC® VR5™) strain and HAdV-F41 (ATCC® VR930™) was obtained from the American Type Culture Collection (ATCC). HAdV-A12, -A18, -A31, -B3, -B16, B21, -B11, -B14, -B35, -C6, -D9, -D10, -D13, -D17, -D20, -D24, -D25, -D26, -D27, -D33, -D37, -D69 and -E4 were clinical isolates obtained from the diagnostic group of the Max von Pettenkofer-Institute (Department of Virology) at the Ludwig-Maximilians-University Munich in Germany. HAdV-B7, -B50, -B34, -C1, -C2, -D8 and -G52 were kindly provided by the Heinrich Pette Institut (HPI) Hamburg, Germany.

Ad Amplification, Purification and Titration—

WT human Ad from clinical isolates were first pre-amplified in individual permissive cell lines (50~80% confluence), with serial infection circles to achieve 90% cytopathic effect (CPE). Each virus was amplified to large scale in 10-20 15 cm tissue culture dishes. For virus amplification DMEM supplemented with 2% FBS was used. Crude cell lysates were used to purify viruses by a CsCl gradient-based ultracentrifugation method (Beckman Coulter), followed by a desalting step based on disposable PD-10 desalting columns (GE Healthcare). The purified virus was aliquoted and stored at −80° C. for further use. Ad particle concentrations were determined by measuring the optical density at 260 nm and expressed as viral particles (VPs) per milliliter.

Adenoviral genomic DNA isolation from virions—

For cloning of viral genomes, viral genomic DNA was extracted from purified particles by the addition of proteinase K, subsequent phenol-chloroform extraction, and ethanol precipitation. A detailed protocol for isolating viral genomic DNA is found in Example 7. To confirm the Ad type on genome level, multiplex PCR and sequencing were performed using the primer pair hexon-fwd (ATGGC-CACCCCATCGATGATGC) (SEQ ID NO: 1452) and hexon-rev (TTATGTGGTGGCGTTGCCGGCC) (SEQ ID NO: 1453) amplifying the hexon regions of the viral genomes. To verify the end-sequence of the adenoviral genome for the following homologous recombineering step, primers reading into the ITR region were designed.

Plasmid Construction— p15A-cm-MCS; p15A-amp-ccdB; pR6K-spect-adapter; pR6K-GLN; Linear-linear homologous recombination (LLHR)-mediated adenoviral genome cloning. Linear-circular homologous recombination (LCHR)-mediated adenovirus genome tagging.

PCR—

Homology arm (HA)-containing long primer-mediated PCR was performed with Phusion® High-Fidelity DNA Polymerase (New England Biolabs, Frankfurt, Germany) according to the manufacture's protocol. Notably, only the primer binding sequence (~20 bp) was used for calculating the annealing temperature. The PCR product purified with the Wizard® SV Gel and PCR Clean-Up System (Promega, Mannheim, Germany) and eluted in ddH2O was used for electroporation. To check virus reconstitution and amplification, OneTaq® 2X Master Mix (New England Biolabs, Frankfurt, Germany) was used according to the manufacture's standard protocol.

NGS and bioinformatics analyses—

For sequencing of plasmids, 200 ng purified DNA was subjected to standard Illumina DNA library preparation. In brief, DNA was enzymatically sheared (NEBnext dsDNA Fragmentase, New England Biolabs). After XP bead purification (Beckman Coulter), ends were polished and A-tailed and universal adapters were ligated (Ultra Directional DNA Library Prep Kit, New England Biolabs). For adapter ligation, custom adaptors were used (Adaptor-Oligo 1: 5'-ACA-CTC-TTT-CCC-TAC-ACG-ACG-CTC-TTC-CGA-TCT-3' (SEQ ID NO: 1454), Adaptor-Oligo 2: 5'-P-GAT-CGG-AAG-AGC-ACA-CGT-CTG-AAC-TCC-AGT-CAC-3' (SEQ ID NO: 1455)). After ligation, adapters were depleted by XP bead purification (Beckman Coulter). Sample indexing was done in the following PCR enrichment (15 cycles). For Illumina flow cell production, samples were equimolar pooled and distributed on two Illumina MiSeq flow cells for 300 bp paired-end sequencing. The Illumina TruSeq adapter and regions of low quality (phred quality <20) were trimmed with cutadapt requiring a minimum length of 50 bp. Trimmed reads were mapped with BWA onto the reference sequence of the vector and reads consisting entirely of vector sequence were discarded whereas reads without or with only partial vector sequence were kept. Each adenovirus dataset was assembled with IVA de novo as well using the respective GenBank sequence as anchor. The better assembly was chosen based on number of sequences, total length and presence of vector sequence at the flanks of the assembled sequence. The remaining vector sequence was identified with BLAT and removed with in-house Perl scripts and the final assembled sequence was orientated according to the respective GenBank reference sequence. Annotation of coding sequences (CDS) was done with Glimmer in two steps. First, known adenovirus CDS from the GenBank were compared to the assembled sequences using exonerate. The resulting alignments served as training set for Glimmer which then predicted the final CDS regions. Functional identification of CDS was based on BLASTP against known adenovirus protein sequences from GenBank. To align and visualize the adenovirus sequences obtained by NGS against their respective GenBank reference sequences, we used the zPicture program (webpage: zpicture.dcode.org/). Sequence alignments between adenovirus sequence and GenBank reference were done with BLASTZ. As cut-off value, we used a minimum sequence identity of 99% which minimizes false-positive alignments but still allows for studying single nucleotide variants between adenovirus sequences and respective GenBank references. Multiple sequence alignments for conserved E3 and ITR sequences were generated using clustal Omega (www.ebi.ac.uk/Tools/msa/clustalo/) with default parameters and for visualized extent of conservation in aligned sequence sets we used WebLogo (webpage: weblogo.berkeley.edu/logo.cgi). Plasmid DNA transfection and virus rescue—10 µg of the p15A-based adenovirus genome containing plasmids were either digested with a combination of two restriction enzymes (PmeI/SbfI or PacI/SwaI) releasing the adenovirus backbone, or with the restriction enzyme I-SceI linearizing the p15A-based Ad genome. To purify and concentrate digested DNA, ethanol precipitation was performed for DNA digested with PmeI/SbfI and PacI/SwaI, and for I-SceI digested DNA a phenol-chloroform extraction followed by ethanol precipitation was conducted.

A549 cells were plated in 6-well plates and at 50-80% confluency 3 µg of digested viral DNA was transfected using Superfect transfection Reagent (Qiagen) according to the manufacturer's protocol. After 24-48 hrs, when the cells grew to up to >90% confluency, the medium was changed to 2% FBS-supplemented DMEM. The cells were maintained for up to two weeks, until cytopathic effect (CPE) was observed. If no CPE was obtained, the cell/virus lysate was collected and ½ or ⅓ of the lysate was used to infect a new well of A549 cells at a confluency of 90-95%. To release the virus from infected cells, the crude lysate was subjected to three freeze/cycles in liquid nitrogen and in a 37° C. water bath. A small aliquot of cells was collected for qPCR analysis.

qPCR Analysis—

To monitor virus replication during rescue, quantitative real-time PCR (qPCR) was performed using the CFX96 Touch™ Real-Time PCR Detection System (Bio-Rad). Previously described primer pairs and probes (Damen, M et al, 2008, JoCM) binding to the hexon of Ad were used to determine the copy number of Ad genomes in infected cells. The PCR was based on the following program: pre-incubation/activation at 95° C. for 5 min, amplification and data collection during 40 cycles (95° C. for 15 s and 60° C. for 30 s). The Sso Fast™ Probes Supermix (Bio-Rad) was used for these PCRs.

Characterization of Tagged Ad In Vitro and In Vivo—

All reconstituted GLN-tagged viruses were confirmed by hexon-PCR of isolated adenoviral genomes. Adenovirus particle concentrations were determined by measuring the optical density at 260 nm and expressed as viral particles (vps) per millilitre.

Nano-Glo Luciferase Assay—

Individual tested cells were grown to confluence in 96-well tissue culture plate and infected with different viral partials (VPs) per cells. 26 h after infection NLuc activity was measured with the Nano-Glo assay system (Promega), and luminescence was detected with a plate reader (Tecan).

Genome Uptake Measured by Internalization Assay—

To quantify the cell entry efficiency, a defined number of Ad particles (vp) was used to infect pre-seeded tumor cells and incubated for 2 hours. Cell monolayers was digested and flushed off with trypsin, followed by extensive washing with PBS. Genomic DNA was extracted by incubation in TE buffer (10 mM Tris-HCl, 10 mM EDTA, pH 8.0) with 0.5% SDS and 0.5 mg/ml proteinase K. Subsequently a phenol-chloroform extraction and ethanol precipitation was performed. To monitor virus genome uptake efficiency, quantitative real-time PCR (qPCR) detecting the transgene (GLN gene cassette) was performed.

Oncolytic Assays with Most Promising Ad Candidates—

Oncolytic assay was performed in 24 well plates. A 10-fold dilution series of individual Ads was prepared freshly to infect pre-seeded cancer cells. Cytopathic effect (CPE) was checked daily until at least one of the viruses on one plate at the lowest dosage showed CPE or until maximal 14 days. The cells were first fixed with 3.7% formaldehyde then stained with crystal violet solution.

Statistics—

Statistical analyses were conducted with Microsoft Excel. Experimental differences were evaluated by a Student's one-tailed t-test assuming equal variance.

Example 2—Gene Annotation

Genes were predicted using Gene Locator and Interpolated Markov ModelER (Glimmer)[38]. For each sequenced genome, protein sequences of known genes of the respective reference from GenBank were aligned with exonerate[39] to the assembled genome sequence. The coordinates of the best hits were then used to build a Glimmer model which was subsequently used for prediction of location and orientation of genes in the sequenced genome.

Next, protein sequences were compared between virus genomes. The result of this analysis is given in FIG. 6. Shown are genome organisations for 28 sequenced human adenoviruses. Genes and their orientation are shown as gray-shaded shapes on both strands of the genome (solid line). All genomes show the canonical organization of the Mastadenovirus genus.

Shading of a gene reflects its maximum sequence divergence across all 28 viruses determined through an all-vs-all Blast analysis.

Example 3—Cell Tropism of Human Adenovirus D17

A new first generation adenovirus based on human adenovirus D17 was constructed and labelled with a green fluorescent protein (GFP) marker using the recombineering technology described in Example 1. The early E1 gene was deleted in the HAdV17 vector, and a corresponding E1-deleted, GFP-labeled HAdV5 vector was constructed for comparison.

Viruses were rescued in complementary E1-expressing stable cell lines, and then screened against a panel of different cell lines by fluorescence activated cell sorting (FACS) analysis and quantitative PCR. HAdV17 was found to have a tropism for endothelial cells, whereas endothelial cells are normally refractory to HAdV5 infection. This finding was further verified using primary human umbilical vein endothelial cells (HUVEC).

Competition assays based on soluble recombinant fiber knob blocking reagents[40, 17] (5knob, 17knob, JO4, Augmab) were used to characterize the receptor interaction with these vectors in vitro. It was found that HAdV17 could utilize both CD46 (a membrane cofactor protein which is expressed on all nucleated cells) and CAR (coxsackievirus and adenovirus receptor) as cell attachment receptors. The endothelial cell tropism was CD46-dependent and could be blocked by the CD46 blocking reagent Augmab.

In vivo biodistribution analyses were performed after intravenous injection of recombinant viruses into both normal and CD46-transgenic mice. These studies showed significantly increased vector genome copies (VCN) in various organs of CD46-transgenic mice compared to normal mice, indicating the involvement of CD46 as a receptor. These results were confirmed by quantitative PCR (qPCR) and immunohistology analysis.

Neutralising antibody assays revealed that there was less seroprevalence with HAdV17 compared to HAdV5 in humans.

Accordingly, HAdV17-based vectors, which can use both hCAR and CD46 as receptors and display an endothelial cell tropism, hold great promise for gene therapy in endothelial disease.

See also FIGS. 11-19.

Example 4—Delivery of all Components of the CRISPR/Cas9 System Using High-Capacity Adenoviral Vectors A new CRISPR/Cas9 shuttle plasmid toolbox was generated, containing the Cas9 nuclease gene, either utilising a constitutive or an inducible promoter, and a gRNA expression unit. The toolbox allows cloning or recombining of all CRISPR/Cas9 components into the HCAdV genome in one step. To use several gRNA expression units for multiplexing the CRISPR/Cas9 system, further gRNA expression units can be easily included. To enable fast assembly of recombinant CRISPR-HCAdV genomes, DNA recombineering was used to introduce all CRISPR/Cas9 expression units into the HCAdV genome contained in the bacterial artificial chromosome pBHCA. For insertion of multiple gRNA expression units into the HCAdV genome, the established pAdV-FTC plasmid was used in concert with homing endonuclease directed cloning. CRISPR-HCAdVs were produced using a shortened amplification and purification procedure.

The toolbox was used to produce several CRISPR-HCAdVs carrying single and multiplex gRNA units specific for different targets including hCCR5, hDMD, and HPV16- and HPV18-E6 genes, yielding sufficient titers within a short time. T7E1 assays[41] were applied to prove CRISPR/Cas9-mediated cleavage of respective targets. Infection of cultured human cells with respective CRISPR-HCAdVs resulted in efficient site-specific gene editing.

In summary, this new platform enables customisation, cloning and production of CRISPR-HCAdV vectors for single or multiplex approaches within a short time. It simplifies the delivery of the CRISPR/Cas9 machinery by only using one single viral vector. Inducible Cas9 expression helps to avoid targeting of the genome of producer cell lines during vector production and may be beneficial for special approaches where constitutive expression is unwanted.

Example 5—Enhanced Oncolytic Activity Mediated by a Novel Human Adenovirus Type 6-Based Vector Most existing oncolytic adenoviruses (AdV) are based on human AdV type 5 (hAdV-5). Clinical efficacy of hAdV-5 based oncolytic viruses is limited by variable expression levels of coxsackie- and adenovirus receptor (CAR) in different tumour cells, and insufficient replication rates. Additionally, high prevalence of neutralising antibodies against hAdV-5, resulting in lower efficiency, makes hAdV-5 a less suitable candidate for systemic application. Recent studies have highlighted human adenovirus type 6 (hAdV-6) as a promising candidate for oncolytic and vaccine vectors. Thus, development of novel oncolytic AdV based on hAdV-6 may help to overcome these limitations. Oncolytic efficacy of the candidate virus can be augmented by expression of RNAi suppressor protein P19, as has been shown previously for hAdV-5[31]. In this example, a novel hAdV-6-based, p19-containing oncolytic AdV was evaluated as a candidate for oncolytic applications in different tumour cell lines.

A P19-containing hAdV-6 based virus (hAdV-6FP19) was cloned by a novel seamless recombineering technique (see Example 1). In order to allow P19 expression from the adenoviral vector genome, the P19 cDNA was fused via an internal ribosome entry site (IRES) to the late fiber gene. After release of the respective recombinant adenoviral genomes from plasmids containing the complete DNA molecule, linearised viral DNA was transfected into HEK 293 cells for virus reconstitution. After initial amplification steps which were monitored by virus specific PCRs, upscaling and virus purification using cesium chloride density gradient ultracentrifugation was performed. Rescue and amplification efficiencies were comparable to commonly used hAdV-5 based vectors.

Various cancer cell lines from different origin were used to perform oncolysis assays. These included: A549 (lung carcinoma), HCT 116 (colon carcinoma), HeLa (cervical carcinoma) and Huh7 (hepatocellular carcinoma). Cells were infected with hAdV-6FP19, hAdV-6 and hAdV-5 at various multiplicities of infection (MOI). Two to three days after infection, cells were fixed and stained with methylene blue. Significantly higher cell lysis (up to 100-fold) was observed for hAdV-6FP19-infected cells as compared to hAdV-5 and 6 at identical MOIs. Higher cell lysis rates for hAdV-6FP19 compared to wildtype virus were present in all evaluated cell lines, suggesting significantly enhanced oncolytic potential for hAdV-6FP19. In summary, hAdV6-based vectors hold great promise for oncolytic applications and their oncolytic effectiveness can be further improved by RNAi suppression.

Example 6—High Throughput Screening (HTS) of Adenovirus Library as a Novel Resource for Disease-Specific Targeting To fully explore our cloned Ad library as a resource for developing of novel translational approaches, the library was further tested on a panel of cell lines using an HTS approach. Cell lines originating from different cell types were infected with the reporter-labelled virus types of the Ad library. Transduction efficiencies measured by luciferase expression levels were compared to the commonly used adenoviral vector type 5 (Ad5). Initial screening revealed that species B adenoviruses have high transduction efficiencies in epithelial (A549, HCT 116, ARPE-19) and endothelial (EA.hy926) cells. While in the liver originated cell lines SK-HEP-1 and Huh-7, the common used vector type 5 (Ad5) highest infection efficiencies (FIG. 20). Also included was an osteosarcoma derived cell line (MG-63) and the breast cancer-derived cell line Hs 578T derived form a triple-negative breast cancer (TNBC). In the TNBC 207 cell line, Ad37 was identified as the most efficient Ad type, while other species B types (Ad16, 50 and 35) revealed improved efficiency compared to the commonly used Ad5 (FIG. 20). After performing HTS on osteosarcoma derived MG-63 cells, it was discovered that Ad21 showed highest transduction efficiencies (FIG. 20).

Therefore, Ad21 was further pursued as a potential oncolytic agent to treat osteosarcoma, because this type of cancer is the most frequent primary cancer of bone which predominantly occurring in the second decade of life. Regarding the age group from 15-19 years, osteosarcomas represent >10% of all solid cancers. Therefore, a panel of osteosarcoma cell lines with different grading related features, including Saos-2 and U-2 OS cells, was further examined.

As displayed in FIG. 21a and in concordance with results obtained in MG-63 cells (FIG. 20), Ad21 was identified as a promising alternative Ad type to transduce osteosarcoma cell lines, which was also confirmed by GFP also expressed form the tagged Ads (FIG. 21b) and by virus internalization assays measuring uptake of virus genomes 3 hrs post-infection (FIG. 21c). The oncolytic potency of selected Ad types was analysed in all three osteosarcoma cells and it was found that Ad21 consistently resulted in efficient oncolysis of respective cell lines at different MOIs tested (FIG. 21d). To show that oncolytic potential varied between different cancer cell lines we also tested the tagged Ad library on lung carcinoma derived A549 cells revealing that in contrast to osteosarcoma cell lines, Ad35 and -69 showed highest oncolytic potency (FIG. 22). This proof-of principle experiment demonstrates that a novel virus candidate for disease specific targeting can be identified by HTS allowing development of novel therapeutic agents in further steps.

Using the same methodology, FIG. 23 shows the high infectivity rates of the Ad5, Ad21 and Ad37 adenoviruses in the glioblastoma derived cell-line RG2 [D74]. This indicates that adenoviral vectors derived from these adenovirus types would be effective in targeting glioblastoma cells.

Example 7—Protocol to Isolate Adenoviral Genomic DNA for Use in the Cloning Step 1. Incubate certain volume of purified virus for 2 hours (or overnight) with proteinase K-SDS solution pH 7.5-8 (TE buffer, 0.5% SDS, 100~500 µg/ml proteinase K) at 56° C., with low speed shake (300 rpm).
2. Add equal volume mixture of phenol:chloroform:isoamyl alcohol (25:24:1) to the sample from step 1. In doing this, go inside to the mixture, and do not take the surface layer. To increase the recovery rate, use a phase lock gel tube (Phase Lock Gel Heavy 1.5 ml, uk.vwr.com/store/product/826754/phase-lock-gel).
3. Centrifuge for 5 min at full speed (15,000 g) at room temperature in a microcentrifuge and then transfer the aqueous phases to another clean eppendorf tubes.
4. Precipitate viral DNA by adding 1/10 volume of 3 M sodium acetate (pH 5), 2 µg glycogen and 2.5~3 times of precooled EtOH (99.8%; stored at −20° C.). Mix gently by inverting the tube several times. To increase the recovery rate, put the mixture in −20° C. for 30 mins.
5. Centrifuge for 10 min at full speed (15,000 g) at room temperature in a microcentrifuge and discard the supernatant by pipetting.
6. Add 600 µl of 70% ethanol and mix gently by inverting the tube several times. After centrifugation at 15,000 g at room temperature for 5 min, remove the supernatant by pipetting.
7. Repeat step 6
8. Air-dry the DNA pellet briefly and resuspend in 20~50 µl of sterilized dH2O low speed shake (300 rpm) at room temperature for 15 mins.

In this protocol, which is provided by way of example, it is important that the large genomic DNA is never vortexed or vigorously pipetted during isolation.

REFERENCES

[1] Aiuti, A. et al. Lentiviral hematopoietic stem cell gene therapy in patients with Wiskott-Aldrich syndrome. Science 341, 1233151, (2013).
[2] Nathwani, A. C. et al. Adenovirus-associated virus vector-mediated gene transfer in hemophilia B. The New England journal of medicine 365, 2357-2365, (2011).
[3] Biffi, A. et al. Lentiviral hematopoietic stem cell gene therapy benefits metachromatic leukodystrophy. Science 341, 1233158, (2013).
[4] Wiley, J. M. Gene Therapy Clinical Trials Worldwide. J. Gene Med., (2015).
[5] Crystal, R. G. Adenovirus: the first effective in vivo gene delivery vector. Human gene therapy 25, 3-11, (2014).
[6] Zabner, J. et al. Adenovirus-mediated gene transfer transiently corrects the chloride transport defect in nasal epithelia of patients with cystic fibrosis. Cell 75, 207-216 (1993).
[7] Wilson, J. M. Gendicine: the first commercial gene therapy product. Human gene therapy 16, 1014-1015, (2005).
[8] Kaufman, H. L., Kohlhapp, F. J. & Zloza, A. Oncolytic viruses: a new class of immunotherapy drugs. Nature reviews. Drug discovery 14, 642-662, (2015).
[9] Hage, E. et al. Human Adenovirus type 70: A novel, multiple recombinant species D adenovirus isolated from diarrheal faeces of a haematopoietic stem cell transplantation recipient. J. Gen. Virol. 96, 2734-2742, (2015).
[10] Davison, A. J., et al. Genetic content and evolution of adenoviruses. J. Gen. Virol. 84, 2895-2908, (2003).
[11] Fu, J. et al. Full-length RecE enhances linear-linear homologous recombination and facilitates direct cloning for bioprospecting. Nature biotech. 30, 440-446, (2012).
[12] Wang, H. et al. Improved seamless mutagenesis by recombineering using ccdB for counterselection. Nucleic acids research 42, e37, (2014).
[13] Harrach, B. et al. Adenoviridae. In "Virus Taxonomy" (ed. King, A. M. Q., Adams, M. J., Carstens, E. B. and Lefkowitz, E. J.), 125-141 (Elsevier, 2011).
[14] Bradley, R R. et al. Adenovirus serotype 5 neutralizing antibodies target both hexon and fiber following vaccination and natural infection. J. Virol. 86, 625-629, (2012)
[15] Zhang, Y. and Bergelson, J. M. Adenovirus receptors. J. Virol. 79, 12125-12131, (2005).
[16] Ghebremedhin, B. Human adenovirus: viral pathogen with increasing importance. Eur. J. Microbiol. Immunol. 4, 26-33, (2014).
[17] Wang, H. et al. Desmoglein 2 is a receptor for adenovirus serotypes 3, 7, 11 and 14. Nat. Med. 17, 96-105, (2011)
[18] Tuve, S. et al. A new group B adenovirus receptor is expressed at high levels on human stem and tumor cells. J. Virol. 80, 12109-12120, (2006).
[19] Danthinne, X. and Imperiale, M J. Production of first generation adenovirus vectors: a review. Gene Ther. 7, 1707-1714, (2000).
[20] WO 2011/154927
[21] Cong, L. et al. Multiplex Genome Engineering using CRISPR/Cas Systems. Science 15, 819-823, (2013).
[22] Li, X. et al. PiggyBac transposase tools for genome engineering. Proc. Nat. Acad. Sci. USA 110, E2279-E2287, (2013).
[23] Hausl, M. et al. Development of Adenovirus Hybrid Vectors for Sleeping Beauty Transposition in Large Mammals. Curr. Gene Ther. 11, 363-374, (2011).
[24] Penaloza-MacMaster, P. Alternative serotype adenovirus vaccine vectors elicit memory T cells with enhanced anamnestic capacity compared to Ad5 vectors. J. Virol. 87, 1373-1384, (2013).
[25] Wold, W. S. M. and Toth, K. Adenovirus vectors for gene therapy, vaccination and cancer gene therapy. Curr. Gene Ther. 13, 421-433 (2013).

[26] Barouch, D. H. Novel adenovirus vector-based vaccines for HIV-1. Curr. Opin. HIV AIDS 5, 386-390, (2010)

[27] Geisbert, T. W. et al. Recombinant adenovirus serotype 26 (Ad26) and Ad35 vaccine vectors bypass immunity to Ad5 and protect nonhuman primates against Ebolavirus challenge. J. Virol. 85, 4222-4233, (2011).

[28] Barnes, E. et al. Novel adenovirus-based vaccines induce broad and sustained T cell responses to HCV in man. Sci. Transl. Med. 4, 115ra1, (2012)

[29] Yamamoto, M. and Curiel, D. T. Current issues and future directions of oncolytic adenoviruses. Mol Ther. 18, 243-250, (2010).

[30] Cheong, S. C. et al. E1A-expressing adenoviral E3B mutants act synergistically with chemotherapeutics in immunocompetent tumor models. Cancer Gene Ther. 15, 40-50, (2008).

[31] Rauschhuber, C. et al. RNAi suppressor P19 can be broadly exploited for enhanced adenovirus replication and microRNA knockdown experiments. Sci. rep. 3, 1363 (2013).

[32] Rodriguez, R. et al. Prostate attenuated replication competent adenovirus (ARCA) CN706: a selective cytotoxic for prostate-specific antigen-positive prostate cancer cells. Cancer Res. 57, 2559-2563, (1997).

[33] Cody, J. J. and Douglas, J. T. Armed replicating adenoviruses for cancer virotherapy. Cancer Gene Ther. 16, 473-488, (2009).

[34] Green, N. K. et al. Extended plasma circulation time and decreased toxicity of polymer-coated adenovirus. Gene Ther. 11, 1256-1263, (2004).

[35] Doronin, K. et al. Chemical modification with high molecular weight polyethylene glycol reduces transduction of hepatocytes and increases efficacy of intravenously delivered oncolytic adenoviruses. Hum. Gene Ther. 20, 975-988, (2009).

[36] WO 2009/104094

[37] Wang, H. et al. Improved seamless mutagenesis by recombineering using ccdB for counterselection. Nucleic Acids Res. 42, e37, (2014)

[38] Salzberg, S. L. et al. Microbial gene identification using interpolated Markov models. Nucleic Acids Research 26, 544-548, (1998)

[39] Slater, G. and Birney, E. Automated generation of heuristics for biological sequence comparison. BMC Bioinformatics 6, 31, (2005)

[40] Gaggar, A. et al. CD46 is a cellular receptor for group B adenoviruses. Nat. Med. 9, 1408-1412 (2003).

[41] Mashal R. D. et al. Detection of mutations by cleavage of DNA heteroduplexes with bacteriophage resolvases. Nat. Genet. 9, 177-183, (1995).

SEQUENCE LISTING (1455 sequences)

SEQ ID NO: 1 - DNA, 34376 bp, Adenovirus A12
  MISC_FEATURE (1)..(34376): Complete Genome
ctgcaggttaattaaggaagggcgaattctgcagatatccatcacactggcggccgctcgagcatgcatctagagggcccaattcgccctatagtgagtcgtattacaattcactggcccctatctaataatataccttatactggactagtgccaatattaaaatgaagtgggcgtagtgtgtaatttgattgggtggaggtgtggctttggcgtgcttgtaagtttgggcggatgaggaagtggggcgcggcgtgggagccgggcgcgccggatgtgacgttttagacgccattttacacggaaatgatgttttttgggcgttgtttgtgcaaattttgtgttttaggcgcgaaaactgaaatgcggaagtgaaaattgatgacggcaattttattataggcgcggaatatttaccgagggcagagtgaactctgagcctctacgtgtgggtttcgatacgtgagcgacggggaaactccacgttggcgctcaaagggcgcgtttattgttctgtcagctgatcgtttgggtatttaatgccgccgtgttcgtcaagaggccactcttgagtgccagcgagaagagttttctctgccagctcattttcacggcgccattatgagaactgaaatgactcccttggtcctgtcgtatcaggaagctgacgacatattggagcatttggtggacaacttttttaacgaggtacccagtgatgatgatctttatgttccgtctctttacgaactgtatgatcttgatgtggagtctgccggtgaagataataatgaacaggcggtgaatgagttttttcccgaatcgcttattttagctgccagtgaggggttgtttttaccggagcctcctgtactttctcctgtctgtgagcctattgggggcgaatgtatgccacaacggcaccctgaagatatggatttattgtgctacgagatgggctttccctgtagcgattcggaagacgagcaagacgagaacggaatggcgcatgtttctgcatccgcagctgctgctgccgctgatagggaacgtgaggagtttcagttagaccatccagagttgcccggacacaattgtaagtcctgtgagcaccaccggaatagtactggaaatactgacttaatgtgctctttgtgctatctgcgagcctacaacatgttcatttacagtaagtgtgctatgggaggtgggaggtgatttttttttcttaagcagtgaaaaataatattttgttgtttttaggtcctgtttccgataatgagcctgaacctaatagcactttggatggcgatgagcgaccctcacccccgaaactaggaagtgcggttccagaaggagtaataaaacctgtgcctcagcgggtgactgggaggcgtagatgtgctgtggaaagcattttggatttgattcaagaggaagaaagagaacaaacagtgcctgttgatctgtcagtgaaacgccctagatgtaattaatggactttgagcacctgggcaataaaataggggtaatgtggtttttgtgagtcatgtataataaaactggtttcggttgaagtgtcttgttaatgtttgtttgggcgtggttaaacagggatataaagctgggttggtgttgctttgaatagttcatcttagtaatggagttggaaactgtgctgcaaagttttcagagcgttcgccagctcttgcagtatacctctaaaaacacttcaggtttttggaggtatctgtttggctctaccttaagcaaggtggtaaatagggtgaaagaagactatagagaggaatttgaaaacatattggccgactgtccagggcttttggcttcactagacctttgttaccacttggtgtttcaggaaaaagtggtcagatccttagatttttcatctgtgggacgaacggttgcttctattgcttttttggcaaccatattggataaatggagcgagaaatcccacctgagttgggattacatgctggattacatgtcaatgcagctgtggagggcatggctgaagaggagggtttgcatttactcgctggcgcggcctttgaccatgccgccgctgccgacgttgcaagaggagaaggaggaggagcggaaccctgcggtggtggagaagtaaacatggaacaacaggtgcaagaaggccatgtacttgactctggcgaagggcctagttgcgcagatgatagagataagcaggaaaaaaaagaaagtttaaaggaagctgctgttcttagtaggctaactgttaatctgatgtcccgcccgcgtttggaaactgtatattggcaggagttgcaggatgaatttcagcggggtgatatgcatttacagtacaaatacagttttgaacaattaaaaacccactggttagagccatgggaggatatggagtgtgctattaaagcttttgctaaattggccttacgtcctgattgtagctacagaattactaaaacagtaaccattacttcatgcgcctatattataggtaacggggcaatagttgaggtagatacaagcgacagagttgcttttagatgtcgaatgcagggtatgggcccaggggtggtgggtttggatggaattacatttataaatgttaggtttgctggagataagtttaaaggcattatgttcgaagctaatacctgtcttgtcttgcatggtgtttactttcttaactttagtaacatttgtgtagagtcttggaataaggtttctgctaggggctgtactttttatggatgttggaagggtttggtgggtagaccaaaaagtaaactgtctgtaaaaaagtgtttgtttgaaaaatgtgtacttgctttaattgtagagggggatgcacatattaggcataatgcagcttcagaaaatgcctgttttgtattattgaagggaatggctattttaaagcataatatggtttgtggggtgtctgatcaaactatgcgacgttttgttacctgtgctgatggaaattgtcataccttaaaaactgttcatattgtgagccacagtagacattgttggcctgtatgtgatcataacatgtttatgcgctgtaccatacatttaggcttaaggcggggtatgtttagaccttcccaatgtaacttcagccactcaaacattatgctggaacctgaagtgttttctagagtgtgtttaaatggggtatttgatttatctgtggaattatgtaaggttataagatataatgatgatactcgacatcgttgccgacagtgtgagtgtggtagcagtcatctagaacttcgtcccattgtgctaaatgtaactgaggagctgagaagtgaccaccttaccctgtcttgcctgcggactgactatgagtcaagtgatgaagacgacaactgaggtaagtgggtggagctaggtgggattataaaaggctggaagtcaactaaaaattgtttttgttcttttaacagcacgatgaacggaactactcagaacaacgctgcgctttttgatggaggggtttttagcccttatttgacttccaggttaccatattgggccggagtacgtcagaatgtggtaggatctacagtggacggtcgacctgtggcacctgcaaattcatcaacattaacctatgcaactattggaccctcgcctttggataccgccgccgccgctgcagcttccgcggccgcttctacggctcgcagtatggcagctgatttcagcttctacaatcacttggcttcgaatgctgtgacacgcaccgcagttcgagaggacattctgactgttatgcttgccaagcttgaaactctaactgctcagctggaagagctatcgcaaaaggttgaggaattagctgatgctactacccataccccagcccaacctgtaacccaataaagaaaaaacttaaattgagatggtgttatgaatctttattgatacttgttttttctgacatggtaagctcttgaccaccgttccctatcattaagaacacggtgaatgtgttccagtattttgtaaagatgagcctgtatattaaggtacattggcattaggccatctttgggatgaaggtaggaccattgaagggcttcatgttccgggttagtgttgtagataatccagtcatagcaacaacgctgggcatggtgattaaatatatcttttaacaacaagctaattgctaatggaagacctttagtataggtattgataaaacggttaagctgggtgggatgcatccgaggtgacatgatatgaagttttgattgtattttgagattggcaatgttacctgccaaatctcttcttggattcatattgtggagaaccacgaaaacggtgtagccagtacacttgggaaatttgtcatggagtttagaaggaaaggcatggaaaaacttggaaacgcctttgtgacttcccaaattttccatacactcatccattattatggcaattggaccgcgagcagcggcttgagcaaaaatgttttctggatcagaaacatcatagttgtggtctagagttaggtcatcgtaggacaacttaacaaatttaggacacagcgttccagattgtggaataatagttccctctggtcctgggacataatttccctcacaaatttgcatttcccaagatttaatttcagatgggggaatcatgtccacttgcggaacaataaaaaaaacagtttctggagcaggtgtaaccagctgggcagaaagcaaattacgcaacaactgagacttcccacagccagtgggtccataaattaccccaattacaggttgcaagtgatagtttaacgaggtgcagctgccgtcttcgtggagaagcggagccacttcattcatcatttgtcggacgcggatgttttgcttggccagttcccctaacagacgctctccgcctaaggaaagtaactcttgtaaagatttgaaatttttaagtggctttaggccatcggccataggcatgtggtccagggtttgcttcagcagttgcaagcgatcccatagctcagttatattttctatgccatctcgatccagcaaacttcctcgttgcgggggtttggctggctgttgctgtaaggaacgaggcggtgagcatccaaatggacgagggttttgtccttccagggacgtaatgtgcgcgtcagggttgtttcggtcacggtgaatggatgcgctcctggttgagcgctggccagtgtgcgctttaaactgaggcggctggtgctgaagcgcgtgtcttctccctgtgcttcggcaaggtagcattttaacataagatcataagacaaagcctctgtagcgtggcctttagcccgtatttttcctttggaggtgctcccgcagtgaggacactgaaggcatttaagggcgtacagttttggagccaaaaaaacagattctggagaataagcatctgcgccacaataactacaaacagtttcacattcaactgaccaggtcagctcaggacatgatggatcaaaaacaagtttccctccgtactttttgatgcgtttcttaccttgcgactccataaggcggcgtcctttctctgtgacaaaaagactgtcagtgtctccgtatacagatttaaggggtctatccttcagtggtattccgcggtcctcctcgtacaggaattctgaccactctgacacaaaagctctagtccaagcaagtacaaaggaagccacatgggaagggtaccgatcgttgttaattaaagggttagaactttctaaggtgtgtaaacacatgtctccttcttcagcgtccatgaatgtgattggtttgtaggtgtaagtcacgtgttcacaattttctggtggtgggctataaaaaggggcgggtccttggtcttcatcgctttcttctgcttcgctgtttacgagcgccaactggttgggtgagtacacgcgctcaaaggcaggcattacctctgtactcaacgtgtcagtttctataaacgatgaggatttgatgtttaatcgccccgctgcaatttctttcattaggctttcttccatttgatcagaaaaaactatttttttgttatctagtttggtagcaaaagatccgtacaaggcattggaaagcagcttggctatagatcttagggtttgatttttgtccctatcggcccgttcttttgcggcaatattgagttgcacatattcgcgtgccaggcatttccaggtggggaaaatggtggtgcgctcgtcagatagcaagcgtaagcgccacccgcgattatgcagtgtaaccagatctacgctggtaactacttcaccgcgcaagctttcattggtccaggctaaacgaccgccttttctagaacaaaaaggaggaagaacatccaactgattttcatctggggggtcggcatctatagtaaaaatgccaggacaaagatttttgtcaaaataatcaattttgcaagtgtaattttccagcgccacctgccattgccgcacggccaatgcccgctcataggggttaaggggaggaccccaaggcatggggtgtgtgagggccgatgcatacatgccgcaaatatcatatacatatatgggctcttttagtactcctatgtaagtaggatagcacctgccgccacgaatgctggcgcgaacgtagtcatatagctcatgtgaaggcgccaggatgttgggcccaagatgtgtgcgctgtggtttttcggcgcggtacaaaatttgtctgaaaattgcatgagagttagaggaaatggtaggacgctgaaacacattaaaatgtgccgcgtcaagacccactgcgtcagtaacaaactgggcgtatgagctacgcagtttttctaccaatgaggcagtcacaagtacatccagggcacaatagtttaatgtttccccgataagattgtaatttttttctcctttttttttccatagttcttgatttaggaggtattcctccttatccttccagtactcctccaggggaaacccatttgcatctgcacggtaagaaccaagcatataaaactgatttaccgccttgtacggacaacatcctttttctacaggcagggcatacgcttgtgcagcctttcttaaagatgtatgagtaagagcaaaggtatctctgaccattacttttaaatactggtatttaaaatcttggtcgtcacaccctccgtgttcccacagtaggaagttagttcgctttttgtagtggggattgggaagggcaaaagtaatatcattaaataatattttgccagctcttggaataaaatttctagaaattttaaagggtccagggacgtccaagcggttattgattacctgagcggcaagaacaatttcatcaaatccattaatattgtgtcctactatatacaactctacaaatcttggctcacccttaattgcaggggctcttttaagatcttcgtaggaaagatcttcaagcgcgactagtccgttttcttcttgagcccattgagacaagtgtggatttttttgtaaaaaagtcatccaaagatcagtagctaaggaggtttgtaagcggtttctataggtacgaaactgttgaccgaccttcattttttctggggttaagcagtagaaagtagtagagtctttttcccattggtcccatccaagttctaatgcaagttgtaaggcatgtttgacaagattgtcatccccagacagtttcatcaccagcataaatgggacaagttgctttccaaatgcccccatccaggtgtaggtttctacatcataggtaataaaaaggcgctcagtgcgaggatgcgaaccgattgggaaaaagtggatctcctgccaccagttggaagaatggctgttgatgtgatgaaagtagaaatctcgtcggcggacagagcattcatgctgatgtttgtaaaagcgtgcgcagtgttcgcatcgttgcacgggctgtatctgttgaatgaggtgtacctggcggcctcgcaccagaaagcagatgggaaaatcaataccacttggcagctgccgttcgtcctcttcctcttctgctgcattgccactaccgtttggatcctcgaaagcgagaacggagagggtgacggtgcccctcgagctgcatgtccagatttcagcacgagaggggcggaaacgggaaatcagggcgtacagcctggagctgtccatggtatcagtcagagagaaaagcatgtccgcggggacagcgcgcaagttgacttcgcacaggcgggtaagagcaggctggaggtgcaggtaatacttaatttctagaggcgtgccgttggcagagtctattgcgtgaagtattccatgagcccggggactaaccacggttccacggtgcacttttccaatgcgcctgcttaaaatcggcggcgcggacgagctcccggaggaagcggcggttcgggtcctgcgggaagcgggggaagcggtatgtcggcctgacgctctggcaggggaaggtgttgagcccgaagttgactggcatgggcgactacccggcgattgatatcttgaatctgtcggcgttgtgtaaacactaccggccctgttgttttgaacctgaaagaaagttcaacagaatcaatctcagtgtcatttactgcagcctgtcttaaaatctcctgaacgtcgcctgagttatcttggtaggcaatttctgccattaattgatcaatttcttcctcctggaggtctccatgtcccgcacgttcaatagtggctgcaaggtcattagatatccgactcataagctgtgaaaatgcgtttagtccaatttcgttccagactcggctgtatactacccctccttcgctgtcccgagcgcgcataaccacttgcgccaagttgagttccacgagccgtgcgaacacgccgtagttgcgcaagcgctgaaacaggtagtttaaggtggtggcaacgtgttctgagacgaagaaatacagaatccaccgacgaagcgtcagctcgttgatgtcacctaaggcttcaagacgttccatggcttcgtaaaagtctactgcaaaattgaaaaactgggagttgcgagctgccaccgtcaattcttcttccaacagacgaataagctcggccaccgtctcgcgcacttcttgctgaaatgcgcccggaactatttcttgttcttcctcttctacctccattatttcttcctcgaccacaggtggtgggggttgtcttcttcgacgccggcgaacgggcagcctgtctacaaatctttcaatcatttcgccgcgacggcggcgcatagtttcggttactgctcgaccgttttcacgtggtcgtaactcaaaaactccacctctaagttctgtttcatgtaaaatgggaaatgaggcgttgcgaggggcgttaggtagggatacagcgctgattatgcattttattatttgctgcgtaggaactccgcgcaaggagctaagcgtctgcatatccaccgggtcggagaacctttcaagaaaggcatctagccagtcacagtcacaaggtaggctaagttttgtttcttctaaagtaccaggaagctgagcaatgctactaataatgtaattgaagtaagctgttttaagcccacgaatggttttaagaagcaccacatctttgggtccggcttgttgaattcgcaggcggtctgccattccccacacgtcactttgacatcgtccaagatctttgtagtagtcttgcattaacctttccacctctacctcgcggtttccgcgatcagccatgtgcgtgcttccgtagccttgcagcggttgtaataaagctaaatctgccactacccgttccgcaagcactgcctgttgaatttgggtaagggtggttgcaaagtcatccacatctacaaagcggtgataagctcctgcattaatggtgtagctgcagtttgtcattactgaccaattaacagtttgcgtgcctggctgtacagtttctgtgtatcgcaagcgtgagtaagcccgagagtcaaaaacatagtcattgcaggtgcgcactaggtattgatagcccacaaggaaatgaggaggaggttcgcgatacaacggccagccaagcgtagccgcagcacctggagcgagatcttccaacatgaggcggtggtattcatatatgtatctggacatccatgtgatgccggcagcggtagttgttgctcgcataaattcgcgggctcggttccaaatattgcgcaggggtaaaaagcgttcaatagttgccacgctttgaccggtcaggcgtgcgcagtcttgaatgctctggacatggaaaaaatgaaagttggtaagcgactcccttccgtggtttggtggaaaagtcacaagggtaccatagcgaggaaccccggttcgaaaccggcaggatccgctatgagcacaagtgaggcgcttgcgcgttgaacccggccaaggacccccagacacggagaggagtctttttttatttattttttcttagatgcatcctgtcctgcgacaaatgcgacctcagcccagggcaaccacggcctcagcagcggtggcgctttcgggctctggcgaacaggaagagcctcaatgtcctacattggagttggaagaaggagaaggcatagcccgattgggcgcccactctcctgagcgtcacccaagggtgcagctcgcccgggacagtcgcgtggcatttgtgcctcgtcagaacatgtttcgcgacaacagcggggaggaagctgaggaaatgcgagactgcaggtttagggccggtcgcgagctgcgccgcggatttaatcgcgagcgactgctgcgtgaggaggactttgagccagatgaacattcggggattagttctgcacgggcccatgtatcagcagccaacttagtaacagcatatgaacaaacggttacagaggaacgtaactttcaaaaaagctttaataaccatgtgcgcacactaatagcgcgagaagaagtagccattggtttaatgcatctttgggactttgtagaagcttatgtacataatccagcaagtaaacccctaactgcccagctgttcttaatagttcaacatagtagagacaatgaaacttttagggatgcaatgcttaacatagctgaaccccagggtcggtggttactcgatttaattaacattctgcagagcattgtggttcaggaacgcagtcttagtttggcagacaaggtggccgccattaattactccatgttaagtttgggaaagttttatgctcgtaaaatctacaaaagtccgtatgttcccattgacaaggaagtgaagatagacagcttttatatgcgcatggctttaaaggtactaacattaagcgacgatcttggagtgtaccgcaatgaccgaatccacaaagcagtaagcgccagtcgccgcagagagctaagcgacaaagagcttatgcatagcttacaaagggcgctgacgggagcaggaacagaggacgagtcgttctttgatatgggcgcagacctacggtggcagccaagcgctcgcgctttggaggcagctggagtggcgtctgctgacgtcactggcgatgacgatgacgaagaccagtacgaggactgatcggccgtaccttttgttagatgcagcgaccggcgatcatcgcggagagggctcctaacctggatcccgcggttttggcggccatgcaaagccagccttctggcgttacagcttcagatgactggacagcggccatggatcgtattatggctttaacggcgcgcagtcctgatgcttttcgccagcagccccaagctaaccgcttttcggccattttggaagcagtagtgccgtctcgtactaaccctactcacgagaaagtgttaaccattgtaaatgctttgttggatagcaaagccatccgcaaagatgaggctggtttaatatacaacgctttgcttgagcgcgtggcacgctataacagtaccaatgtgcaggctaacttagaccggatgggtacagatgtaaaggaggcgctggctcaacgagagcgctttcatcgcgatggtaatcttggttcgctagtagcattaaacgcttttttgagtactcagccggctaatgttccgcgtggtcaggaagattatacaaacttcatcagcgccttgcgactaatggttactgaagtgcctcaaagtgaagtgtatcagtctggacccgattacttttttcaaacgtccaggcagggtttgcaaaccgtaaacttaactcaggcttttaaaaatttgcaaggtttgtggggggttcgtgctccagtaggcgatcgttcaactttgtccagtttactaacaccaaactcgcgcctattactgttgctaattgccccctttaccaacaccaacagtttaagtcgagattcatacctgggtcacttagttactttgtaccgcgaagccattggtcaagcgcaggtagacgaacaaacttatcaagaaataaccagtgttagtcgcgcactgggccaggaggacactggcagtttagaggccacacttaactttttactaactaaccgtcgccagcaagtgcctcctcagtacactttaaatgcggaagaagaacgcatattgcgctatgtacagcaatctgtaagtttgtatcttatgcgtgagggtgccacccccagtgccgccttagacatgacagcgcgcaatatggagccgtccttctacgcttccaatcgagctttcattaatcgcttgatggattaccttcaccgcgctgcggccatgaacggggaatactttacaaatgcaattctaaatccgcattggttgccccctcctggattttacactggtgaatttgatttgccggaaggaaatgatggctttttgtgggatgatgttacggacagtctgtttagtcctgcagttattggacaccatggtaaaaaggaagcaggtgatgaaggtcccttgcttgactctcgggcgagttctccattccccagtttaactagtttacccgccagtgttaacagcggtcgtaccaccagaccccgactaacaggtgaaagtgaatacttaaatgaccccatcttgtttccagtgcgcgacaaaaattttcccaacaatggcatagaaagtttggtagataaaatgtctcgctggaaaacatatgcacaagagcggcgagaatgggaggaaagacagccaagaccagttcgccctcctaggcaacgttggcagcgacgcaaaaaaggggcacatgcgggggatgaaggaagcgatgactcagctgacgacagtagtgtattagatttaggagggtcaggaaacccatttgctcatttgcgcccacagggttgcatagggtcattgtattaaattgaataaaagcatacttaccaaagccatggcgaccagtgttcgtcttattttccttcttccgttagctgtgaaatgaggcgcgcggtggaactgcagacagtggcttttcctgagacaccacctccctcttacgaaaccgtgatggcagcggcgccaccctacgtgcctccccgctatttgggtcctacggagggaagaaacagtatccgttactcggaattgtcaccgttgtacgataccactcgagtgtacttggtggacaacaagtcttctgacattgcttcattgaattaccagaatgatcacagcaactttttaaccactgtagtgcaaaataatgactattcccctatagaggctggcacgcaaactattaactttgatgaaaggtctagatggggtggagatttaaaaaccatcttacataccaacatgccaaacgtgaacgattttatgtttaccaccaaatttaaggccagggtaatggtggctaggaaaacaaacaacgaaggccaaaccattttagaatatgagtgggcagaatttgtgctacccgagggtaactattcggaaaccatgactattgacttaatgaacaatgctattattgagcattatttgcgagtaggaagacagcatggagtgctggaaagtgacattggagttaagtttgacaccagaaactttcgtctgggttgggaccccgaaacccaattagtaactccgggagtgtacactaatgaggcttttcatccagatatagtactgcttccaggttgcggggttgattttacagagagcagattaagcaacatactaggtataagaaagaggcagccgtttcaggaaggatttgtgattatgtatgaacacttagagggaggcaatattccagctcttttggatgtaaaaaaatacgaaaacagtctgcaggatcaaaacactgtaagaggagacaactttattgccttaaataaggctgctaggattgaaccggttgaaacagaccccaaaggacgcagttacaacttgcttccagacaaaaaaaatactaaatatcgcagctggtatttggcatacaactacggagacccagaaaaaggagttcggtcatggactctactaacaactccagatgtaacaggcggctccgaacaggtgtactggtccctacccgatatgatgcaagatccggtgacttttcgctcctcgcgtcaagttagcaactatcctgtagttgcagcagaattactgccagttcatgctaaaagcttctacaacgagcaagccgtctactcacagcttattcgccagtcaaccgcgcttacgcgcgtgtttaatcgctttcccgagaaccagatactggtgcgtccaccagccgctaccatcactaccgtcagtgaaaacgttcccgcccttacagatcacgggaccctgccgctgcgtagcagtatcagtggagttcagcgagtcaccatcactgacgcccgccgccggacctgtccctacgtttacaaagcactgggcatagtttctccacgagtgctttctagtcgcactttttaaaaaagtgtggtaacatgtccattttggtttcgccaagtaacaacacgggctggggactgggtgccgcccgcatgtatggaggagctaaaacaaggtctagccaacatccagtgcgcgtacgcggacattaccgagctccatggggcgcgcatacccgaggacgcactggtcgcaccactgtagacgatgttattgactcggtagtggccgatgctcgcaagtaccgcgcgcccgctgaaacagcagggtctactgttgatgcagtaattgatgaggtagtggcaaacgcgcgggcttatgcaaggcgccgcagacggctgcgtcgccggcgtagaccaaccaccgccatgcgcgcggccagagcgttggttcgacgggccaggcgcattgggcggcgagctatgatgcgggcagccaggcgggctgcaacgcctgccggtcgagcgcggagacgggccgcagctgcggccgcaacagctattgcaaacctagctgctccgcgacgaggaaatgtatactgggtgcgcgactcagtgaccgggacgcgtgtgccagttcgtacgcgtccacctcacccttagaagacaaagagtgactcaatgtctgttatgtatgcccagcatgaccaaacgcaagttcaaagaagagctgctgcaggccttagcgcctgaaatatatggcccatcggataaccttaccaagcgcgatatcaagcatgttaaaaaacgggaaaaaaaagaggaagaagtcgccgcggcgtcagcagacggcgtcgagtttgtgcgctcatttgcgcccagacgtagggtacagtggaagggacggcaagtaaaacgcattttgcgaccgggcaccacagtggttttttctcccggagagcgaacgattatgcgtcccctaaagcgcgagtacgacgaagtgtacgcagacgatgacattttggagcaagcggcacaacagactggggaatttgcatatggaaaaaaagggcgttacggagacaaaattgctattcctttggacgagggaaatccaacacccagtttaaaggctgtcactttgcaacaagtgttgcccgtccttgggccttcggaagaaaagcgtggaattaaaagggaagccatggatgaattgcagcctacaatgcaactgatggtgcctaagcggcaaaagttagaggacgtactagagcacatgaaggtggatcctagcgtacagccagatgtaaaagtacgtccgataaaaaaggtagctccaggattgggagttcaaacagtggacattcaaattcctgtgcaaactgcattgggtgaaactatggaaatccaaacttcgccaataaaaacaacggtgaacgcaagcgtgcaaacagacccttggtacccgccagtgctttcaacaaaaaaaaaaaagcgtcactacagacaaacaagttcgcttttgccagactacgttttacatccttccattgtgcccacgcctgggtaccgtgggacaacttttcagcgccgagccacagcccctagccgtagacgaggtccatcacgccgtagacgtcgacgcaaagccactttagccccagcggcagtacgtcgcgttgtacaaagggggcgcacactaatacttccatccgtgcgttaccaccctagcattctctaacaagctgcgctgccgttttttcagatggctcttacttgccgaatgcgcatacccattccaggatacagaggacgaccccgccggaggaaagggctgaccgggaacggtcgatttcggcggcgtagtatgcgcagacgcatgaagggtggggtgctgcccttcctaattccacttattgctgcggccattggagccgttcccggaattgcctcagtagccttgcaggcttctcgaaaaaattaaaataaaataaaacttccaacttattactggtactatgactgttttatgcagactaaatggaagacatcaatttttcgtcgctggccccgcgacacggcacgcggccgtacatgggcacctggaacgagatcggcacgagccagctgaacgggggcgccttcaattggaacagtatctggagcggtcttaaaaattttggttccacgattaagacatatggcaccaaggcgtggaacagccaaaccggccagatgctaagggacaagttaaaagaccaaaattttcaacagaaagttgtagatggtctggcttcgggaattaatggagttgtagacatagccaatcaggctgtacagaaaaaaattgccaaccgtttagagccgcggcccgacgaggtaatggtagaggaaaagctgccacctctagaaactgtgcccggatccgttccaaccaaaggagaaaagcggccacggccggatgcagaggaaaccttagtaacgcacacaacagaaccgccgtcctatgaggaagcaataaaacaaggagccgctctgtcacctaccacctatcccatgaccaagcctattttacccatggctactagagtgtatggaaaaaacgaaaatgtgcctatgacccttgagctgcctcctttgccagaacccactatcgcggatcccgtaggttccgttcctgttgcatctgttccagttgcatcgacagtgagccgtccagcagtgcggcctgttgccgtggctagcttgcgaaacccacgatccagtaattggcaaagtaccctaaacagtattgtgggactgggagtaaagtctctcaaacgccgacgctgctactaacattaaaagacgagtgttaattcccatctgtgtatacgcctcctatgttagcgccagaggaccaacgcgtgaatcgcagtcaccaccagcgctttcaagatgatggccactccctcgatgatgccgcagtggtcttacatgcacatcgccggtcaggatgcctcggagtacctgagtcccggtctggtgcaattcgcccgcgccacggacacctacttcaccctgggaaacaagtttagaaaccccaccgtggctcccacccatgatgttaccaccgatcgctcgcagcgtctgacgctgcgttttgtgcccgtggatcgggaagatactacctactcctacaaggctcgctttacgctggctgtgggtgacaaccgcgtgttagacatggctagttcttactttgacattcgaggggtactggatcgtggtcccagttttaagccctattccggaaccgcctacaattctttggcaccaaaaggcgctcctaatgcttcacaatggtcagataacgctaagcttaatacctttgctcaggcgccgtatcttagcgacactatcaccgccgccgatggtattaaagttggaacagacaccgcccaggcaggcgcggcggtgtatgccaacaaaacttatcagccagagccgcaagtaggaccaagtgaatggaacaccagcattgaaaacgttaaagctggcgggagggcattaaagcaaaccactgcaatgcagccgtgctatggctcctacgctcgtccaaccaacgaacacggaggacaatccaaggatgacaacattgaacttaagttctttgattcagctaacaatgcagcaaacactgctcaagttgtgttctataccgaagacgtaaaccttgaaatgccagacacgcatcttgtgtttaagcctactgttaccaatggaacaattgcttctgagtcgctgttgggacagcaagcagcgccaaatagagcaaactacattgcattcagagataattttattggcctgatgtattacaacagtacaggcaacatgggtgtattggccgggcaagcttcccaacttaacgcagtagtagacctgcaagacagaaatacagagctgtcataccagttaatgctggatgctttgggagacagaacacggtacttttccttgtggaattccgcagtggacagttacgaccctgacgttcgcgttattgagaatcacggggtagaggatgaactaccaaattattgctttcctcttagcgcagtaggtgaaataaaaaattacaaaggcattaagccagataacggaggaggaggtggctggactgccgacaacactgtcagtgaagcaaaccacataggcattgggaatatagccgccatggaaattaatttgcaggctaatttgtggagaagcttcttgtactcaaatgtgggcttatacctaccagacgacttaaaatacactccaggaaacataaaactacctgataacaagaacacctacgagtacatgaacgggcgtgtgactgccccggggttggtggatacctatgtcaatatcggcgctcgctggtccccagatgtgatggataatgtaaacccttttaaccaccaccgaaacgcagggttgcgctacagatccatgttgctaggcaatgggagatttgttccttttcacattcaggtgccgcaaaaattttttgccatcagaaatttgttgctgttgcccggttcctacacttacgaatggaactttagaaaggatgtaaacatgattcttcagagcacactgggaaatgatcttcgggtggacggagccagcgttcgctttgacaacattgccctgtatgctaacttttttcccatggcacataacacagcttctactttagaagccatgttaagaaatgacaccaacgaccagtcttttaacgattatttgtgtgctgcaaacatgctgtatcccatcccagctaacgccaccagcgtgcccatttcaataccttcgcgaaattgggcggcatttagaggctggagctttactcgcctaaaaactaaagaaactccttccctgggttcagggtttgacccctactttgtatactctggaaccattccctatttagacggcaccttttacctaaaccacacttttaagaaggtgtcaatcatgtttgactcctccgtgagttggcctggaaatgaccgtttgctaaccccaaatgaatttgaaataaagcgttctgtggatggggagggatacaatgtggcccaatgcaatatgactaaggattggttcctaatacaaatgcttagtcattacaacattggataccaaggtttttacattccagagagctacaaggaccgcatgtattctttctttagaaactttcagcccatgagtaggcaagttgtggataccacagaatataagaactacaaaaaagtaaccgtagagtttcaacataacaactcaggattcgtgggatacctgggccccactatgcgggagggacaagcttaccccgccaactatccctaccctcttataggcaaaacagctgtggaaagcatcacacagaaaaagtttctatgcgatcgtgttatgtggcgcatcccattttctagtaacttcatgtctatgggggcgctaacggatcttgggcaaaatatgctgtacgcaaactcagcccatgctctagacatgacatttgaggtggatccaatggatgagcctacccttctttatgttttatttgaagttttcgacgtggtacgcattcaccagccacaccgcggcgtcattgaagcggtctacctgcgcacgcccttctcggcgggtaacgctaccacctaagaaggcaccctcccagactgctgtaatgggttcaagcgaacaggagctgacggccattgttcgagatctaggctgtggaccctattttttgggaacctttgacaaacgttttccgggttttgtgtctcgcgaccgcttatcatgtgctattgttaacactgccggtcgcgaaactgggggcgtacactggctggcttttggatggaaccccaaatcgcacacttgctatttattcgatccatttggattttctgatcaacgactaaaacaaatctatcagtttgagtacgaaagtctgttgcgccgtagtgcgctagcggccactaaagaccgatgcgttaccctagaaaagtcaacccaaactgtacaaggaccgttttctgcagcgtgcggcctgttttgttgtatgttcttacacgcttttactcactggcctgaccatccaatggataaaaatcccactatggacctacttactggggtgcctaattgtatgctacaaagtcctcaggtagtgggcacattgcaacgcaatcagaatgaattgtataaattcttaaacaatctgtccccttactttcgtcacaaccgcgagcgcatagaaaaagctacatcttttactaaaatgcaaaatggactcaaataaacgtgtacacaatgcattaataataaaaccattttattagctcattggagtacaagcttgactgttttattaaaaatcaaatggctcttcgcgacagtcgccgtggttggtgggcagggatatgtttctgtactgcaaacgctgatgccacttgaattctggaataacaagcctaggggggggagccgtcaaaattttctccccacagctggcgcacaagttgcagggcgcccataacatcaggagcagaaatcttgaagtcgcaattagggccagcattgccgcgcgcattgcgataaactggatttgcgcactgaaaaaccaacaaacacggatacttaatactggctaacgctccagggtcggttacttcgttgatatcaatgttatccacattgctgaggttaaaaggagtgattttacacagttgacgccccatccgtggcaggccatcttgcttgtttaaacattcgcagcgcactggcataaggagacgtttttgcccatgtcgcatgtgagggtagtcggccagcataaaagcttcaatttgcctaaaagctatttgagccttcattccttcagaataaaacaagccgcaggactttccggagaaagaattattcccgcagccaacatcatgaaaacagcagcgggcatcgtcgtttttaatttgaactacattacgcccccagcggttttgcgccaccttggctttcgaggggttctctttcaacgctcgttgcccactttcgctggttacatccatttccaccaaatgctctttgcgcaccatctccattccatgcaggcatctaagctccccttcgcgctcggtacacttatgctcccacacgcagcaaccggtgggttcccaggaattctgttggacaccggcataagcttgcatatatccttgcaaaaagcgtcccatgagctcctgaaaggttttttgggatgaaaaagtcagctgcaaaccgcgcttttcttcgttgagccatgttgtgcatattttcttgtacacgctgccctgatccggcaaaaaacgaaaggtggcgcgctcgtcgtgatccacatggtacttttccattagcatagccatggcttccatgcctttttcccaagctgaaactaggggctggcttgccggattgcgaacaacaacaacaacattcttttcattttcgtcgctgttttgagcggaagccttcaaaacgtgtacctgcctggtttccattttttgaaaagactgagaaccgtctgcatgatgcataatgcggacgggcggcatgctgaaacccattactcctaaaactgctcttggtggttctgcctcttcttcttctgcactctctggggaaagaggtatcgcagccatagatttcttgacttttttctttggaggtaaaggcacagcttccagttcttcttcgctttcggaatccagaaagtatctgcccatttttggcggcggcggctgagcgctgcggtctggggtgcgctccctctgtgagtgctgattgctggccattatttaatcctaggcaaagaaacacatgatggatctggagccacaggaaagcttaaccgcccccaccgctcccgccattggcgctacggctgtcatggagaaggacaaaagtctactcataccccaagacgcaccggttgagcagaacttgggctacgagactccccccgaggaatttgaaggctttcttcaaatccaaaagcaaccaaatgagcaaaacgctgggctcgaggaccatgactacctaaacgagggagatgtcctgtttaaacatctacagcgacaaagcactatcgttcgcgacgccatatctgatcgctcttcaataccagtttcaattgcagaactatcttgcatctacgaacgcaacctgttctccccacgtgtgccccctaaacggcaagccaacggcacatgcgagccaaatcctcgccttaacttctacccagtttttgcagtgccagaagcactggcaacataccatattttctttaaaaatcacaaaatacccctatcctgtcgagctaaccgcagccgcgcagatgagcttcttgctttaagggctggcgcttccatacctgggattgtgtccttggaagaggtgcctaaaatttttgaaggtttaggtcgggatgaaaaacgagcagcaaatgccctgcaaaaagaaaatgaacaaaatcaccatgggaatagtgctctaatagaactggaaggtgacaatgcccgcctggcagttttaaagcgcaatattgaggttactcactttgcctacccggcagtaaatcttccgccaaaggtaatgagcgcagtgatgaatcagctactaattaagcgagcccaacccattgacaaagatgcaaacttgcaagacccggaggcaacagatgatggaaagccggttgtaagcgacgagcaattaactaagtggttgggaacagacaattccaacgaactacaacagcggcgtaaactcatgatggccgccgtacttgtaactgtggaactcgagtgcatgcatcgttttttctccgacatcaccacattgcgcaaaattgaggaatgtcttcactacactttccgccatggctacgtgcgccaagcctgtaaaatttctaatgtggagctgagcaatctagtttcttacatgggcatcttgcatgaaaaccgattgggacagaacgtgctacactcaacactacgcgatgaagcacgcagagattacgtgcgagactgcatttaccttttcctgttacatacctggcaaactgggatgggtgtttggcagcaatgcttggaagaaaaaaaccttcgagaactaaacaaactgttagacagagcactaaaatccctatggaccggttttgacgaacggacagtagctgcagagctagctgacataattttcccagaaaggttaatgataaccttgcaaaacggcttgcctgactttatgagtcaaagtatgctgcacaattatcgctcttttatattagagcgttctgggatgcttcctagcatgtgttgtgcacttccttcagattttgtgcctatatattttagagagtgcccccctcccctgtggagccactgctacttactacgacttgctaactacctagcttaccactcagaccttatgacagattcaagcggcgaaggcctaatggagtgtcactgccgctgcaatctttgcaccccccaccgttctttggtttgcaatactgaactattaagtgaaagtcaagtcattggtaccttcgaaatgcagggaccgcagtctgacagcaatttcacgacgaacctaagacttacccctgggctttggacttctgcctacctgcgcaaatttgaaccccaagattaccacgcccacagtatcaatttttacgaagaccaatccaaacccccaaaagcgccactaacggcttgcgtcattacgcagggaaaaattctagcccaattgcatgctattaagcaagcgcgcgaagagtttttacttaaaaaaggacacggagtgtaccttgatccccaaaccggcgaggaactaaaccttccatcacctttgtgtgctactgcgtctccccattcgcagcatgtccccgaaagccgcaaaacaggctattgcgcagcaacgctcaaagaaacagcagcaacggcaggaaatctgggaggaagaatcttgggagagtcaggcagaggacgaggtcgaggacttggaagaatgggaggaggaggaggcggacagcctagacgaggatccagaggaggaggaggaaggttccaaggacggagcgaccgccgcaaaaccgtcgctttcaaccaagccctctccaatgaaacccgctgtgagcaaatctcagaaagccagccgtagatgggacaccattgaaaccagcgccgcaaacttgggtaagaatcgcaagcaggcgcgtcggggctactgctcatggcgggctcacaaaagtaatattgtagcctgcttgcagcactgcggggggaatatctcatttgcaaggcggtatttgctataccatgatggagtggcgattccaaggaatgtcctccattactaccgtcatctctacagcccctttgaagagctcgacaaggaaccgacctgcaacagccaagcggcccactagaatcggcaacagcagcaacaaggaaagtcctgaggcgcgcgagttaagaaaacgcatttttcccactttatatgctatttttcagcagagtcgaggtcaagaacacgaactgaaaataaaaaaccgttccctgcgttcacttacccgcagctgtctctacctcaaaagcgaagatcagttgcaacgcaccttgcaggacgcagaagctctgttcaataaatactgctccctctcgcttaaagagtaaaaaaagcccgcgcgcggactttcaacaggcgggaaaagtgacgtcacaacaagatgagtaaagatattcccacgccttacatgtggagctttcaaccgcaaatgggactggcggccggcgcggctcaagactattctagcaaaatgaattggttaagcgccggaccccacatgatttccagggtgaatggggtacgagcccggcgtaaccaaatactgctagaacaagccgctctcaccgctacaccacgtaatcaacttaaccctccctcttggccagctgccctgatatatcaggaaaatccccctcctaccactgtacttttgcctcgcgacgcccaggccgaagtccatatgactaacgctggggcacagcttgcgggcggtgcacgtcacagtttcaggtataaaggtcgcactgagccctatccgtctccagctataaaaagagtactcatcagagggaaaggtattcagctgaacgacgaagtcacatcgccattgggagtcagacccgacggagtgtttcagctcggagggtccggacgttcctcctttaccgctcgtcaagcctacctgacactacagagctcatcctcagctccgagatctggtggtattggaactctccaatttgtggaggaatttactccatctgtttacttcaatcctttttcgggctcgcctggacactatcctgacgccttcatacccaactttgacgcagtgagtgaatctgtggatggctatgattaatgtctaatggagcggctgacagagcgcggctgcgacatttagaccactgtcgccaacctcactgctttgctcgagacatctgtgtctttacctactttgagcttccagaggagcacccccaggggccagctcacggtgtcagaataacagttgaaaaaggaattgatacacacctcattaaatttttcaccaaacgcccgctattggtggaaaaagatcaaggaaatactatattaactttatattgcatttgtcctgttcccggattacatgaagatttctgctgtcatttgtgtgctgaatttaatcatctgtagtggcgctgtaccgcctgaagaagaacctaactgtcatccgcatttaagcaacattaaaatcaacctttcgatccctcatatcactcttcgctgcagttttttttccacacatctcacctggacctttaacggaaaacacgttaccaatacagatataaagtttaaactacacaaagaaaacatcactctatttcaacctattaacctgggatactaccgctgctcagctccaccctgtacgcaagcattttttgttgctccagttattgacaaacgccctgctccgacaacagctgctgtcactgagcacatcaccgaggcagtttctccttctaaaggtacagaggaaattgtgtacttttcaaactttacaaaccacttagttttaaattgttcctgttctaactccttaatttcatggtttgctaacagctctctgtgcaaaactttctaccaaggaaaacttttgtattctgctaaactcacattgtgtaaccagagcaccccttcccaccttactctattgccaccttttgttgccggtcgttacttttgcataggagctgcacgtactagcccctgtcaacagcattggaatttaacttactgtcccccaccagtgtcgccctttgtgatcaatactgaatatttagactataatcccttgcttgcttacggcggtctcgcagctcttattttattcctgatttctaacttgtttctagtgcaacatttgtattcatactaacaatgctttccatttttcttttatttctcttttctttaccttctggcttgtatgctcaaacagccgaaagaccactaaaagtcgtggtggaagctggccataatgtaacccttccccacctttctggttcacaccaaactggccatgttacttggctagtagagacatcagattatggttcagcttctccagacaacttcattttcagtggacaaaaactatgccagtttactgacagaaccatggtgtggccttattacaatttacattttaactgtgaaaattatgaccttaatctgttttggcttaaggtggaaaattcggctatttacaacgttaaaaatacagtcaatgcttctgaaacaaatatttactatgatttaagagtagtacaaatttttccacctaaatgcatcattacttcaaagtaccttacaaacgattattgtcacattacaattaactgcactaactctgattaccccaataaggttgtgtttaataatgtcagtcgatggtactacggatacggtaagggcagcccaacccttcccaactactttataactaactttaatgtttcaggtattactaaaagctttaatcacacttacccttttaatgagctctgtgattatcccacatcccaatctcaacacagtttaacacatacagtaagcacagtaatctttttaggaataattggcttcagcattttgattattatagcagcctttatttatctgtgctggcatagaaaatctttgtgtgtttctaaaacagaacctcttatgccgattccttactagttttcttttttcttacagtatggtgacggttcttctcatctttttatgcctgccagtcattttttcttcttcgacttttgccgcagtcagtgaccttgatcccgagtgtttagccccctttgcggtgtacctgattttcacatttgtgactgctacctgcgtctgcagtattattactctgctaatcacctcgctccaattttttgattactactacgtgagaattgtttaccgcagacaccacccccgttaccaaaaccctcaaattgcggctcttttgcagctccaaccatgaaaacagcattagttcttttctttatgttaatcccagtttgggctagttcttgtcaactacataaaccatggaattttttagattgttatactaaagaaacaaactacataggctgggtttatggaattatgtctggcttagtatttgtctcctctgtagtttctttacaactgtatgcgcgccttaattttagttggaataagtatactgatgatcttcccgaatatccaaacccccaggatgatttacccctaaatattgtatttccagagcccccgcgtcctccttctgttgttagctattttaagttcaccggtgaagatgattgaacctgatctagaaattgatggaagaatcaccgaacagaggctcctcactgatcgcgctaggcgacgccaacaggatcaaaaaaataaagagttaattgatttacaaaccgtgcatcagtgtaaaaaaggacttttttgcctggtaaaacaagctacccttcgctatgaatctttaccaggcaaagaacatcaactgtgctacacgctgcccactcagcgacaaacctttactgcaatggtgggctcggtacctattaaagtgtcccaacaagcaggagaacaagaaggctctattcggcgcctatgtgataaccctgaatgtttgtacactttaataaaaacactgtgcggtttaagaaatcttttaccaatgaattaaataaattacttaccggaaatctgaaaatacatcatggtctccgtgtactcttataaaatttccctcttcccaactgtcaaacctgacagacttgcaaacagcaaactttctccaaatcttaaatggaaggtcagattcttcttcccaatccctacccaccatcttcatcttttctagatgaagcgcagcagaacccagtatgctgaagaaacagaagaaaatgatgacttcaaccccgtttacccttttgacccatttgacacatcagacgtaccctttgttacacccccttttacttcttccaatggtcttcaagaaaaaccaccaggtgtattagcacttaattacaaagaccccattgtaactgaaaatggaacccttacactcaagctaggggacggaataaaacttaatgcccaaggtcaacttacagctagtaataatatcaatgttttggagccccttaccaacacctcacaaggtcttaaactttcttggagcgcccccctagcagtaaaggctagtgccctcacacttaacacaagagcgcccttaaccacaacggatgaaagcttagccttaataaccgcccctcccattacagtagagtcttcgcgtttgggcttggccaccatagcccctctaagcttagatggaggtggaaacctaggtttaaatctttctgctcccctggacgttagtaacaacaatttgcatctcaccactgaaactcccttagttgtaaattctagcggtgccctatctgttgctactgcagaccccataagtgttcgcaacaacgctcttaccctacctacggcagatccgttaatggtgagctccgatgggttgggaataagtgtcactagtcccattacagtaataaacggttccttagccttgtctacaactgctcccctcaacagcacaggatccactttaagtctgtctgttgccaatcctctgactatttcacaagacacattgactgtttccactggtaacggtcttcaagtgtcggggtctcaattagtaacaagaataggggatggtttaacattcgataatggggtcatgaaagtaaacgttgccgggggaatgagaacttctggcggtagaataattttagatgttaattatccctttgatgcgagcaataacctgtccttaagacggggattgggactaatttataaccaatctacaaactggaacttaacaactgatattagtaccgaaaaaggtttaatgtttagtggcaatcaaatagctcttaatgcaggtcaggggcttacatttaataatggccaacttagggttaagttgggagctggacttatttttgattcaaacaataacattgccttaggcagcagcagcaacactccatacgaccctctgacactgtggacaactcctgacccaccaccaaactgcagcctcatacaagagctagatgcaaaactcaccctgtgcttaacaaaaaacggatctattgttaatggcattgtaagtttagtgggtgttaagggtaatctcctaaatatccaaagtactactaccactgtaggagtgcatttagtgtttgatgaacagggaagattaatcacatcaacccctactgccctggttccccaagcttcgtggggatatagacaaggccaatcagtgtctaccaatactgttaccaatggtctaggttttatgcctaatgtgagtgcttaccctagaccaaatgccagtgaggctaaaagccaaatggtaagtctcacgtacttacagggagatacatctaaacctataacaatgaaagttgcatttaatggcattacgtcgctaaatggatactctttaacattcatgtggtcaggtctatcaaactatataaatcagcctttctctacaccatcctgctccttttcttacattacccaagaataaaaacacacacaaaacacaaattgcgtacttattgtttattttttttttttttttacactatacgcgtggttaaactgcctccttcccattttaccttgtatacctccctttccccctttgtagctgaaaacaactgcacttgaatatttcgacttaggttttttggcgttagcgtccacacagtttctttacgggcaaagcgagggtcggtgatggaaacgaatccctcgcccgcacagtcactcaagcggcattccccatccaaaaccaggtccatgattttatcctacaaaaagtaacaacagtcagtgtccatcagccgcccaaggattctctcgttgattataatctccaaataaaattgctcgatgatgcataattaaaccctttagcagttgctgacgataacgttcatgccgactatgttttagagggcgaacagtgttttcagcaattacttgaacaacttttaacattagcagtctggtacgacgagcgcaacagcgcatgcgtatctcacttaagtctttacaataatcacaacacagcactaacatgttatttaaaattccataattaaaggcgctccatccaaaactaactttttctaacgctaaccaggcatggccatcatacataattttaaagtaaattaaatggcgacctctaacaaaggtgcttcccacatacatcacctctttaggcattaaatggttaacaacctcccgataccaaaaacaccttttgttaattaaggcgccatatacggccattttgaaccagcgtcccaaaagcatcccagctgacatacactgtagtgaacccggacgctggcaatgacaatgaataagccaccgctcatgaccatgtaataattgagtaacttcaacatttatagtggcacaacacatacatacactcatgtattttttcaaaataaacatctcataatcagttagaatcatatcccacggtattggccattcctgcagcactgtaaaacctacacatgaaggaatgcctcttacctcacttacattatgtaaagtcagactattacactcaggccataaagaattttccgaagtactcaacgtagcttttgactgttcctcacagggcggtagttggtacttgttgtatggtgccaatctgtagcgataccgtctgtcgcgctgcatcgtaaacaacagacttgcgagcgtcttcgtacttaaaaaaacaaaaccacgtacgaccactggttatcgcacctcgtcctttttgtttgcagcgttggcgttccgtcaaaaaagcaaagtacaaccactctcgcaggcttgctaaaatgtattcagcttcaggtgttatcttcaaatcatgatgtttaataaagcgcagagtatccacacaggatgcatgggctaaaccaagccatgctatgcaggcagccgtgtcccgacttacaggaggaggaggaatacaaggtagaggcataaaaacttaatcaagacggtcagcaaggatttgaatgcgtaaatctcgcaggtggcagcgatcgcctccgctgtgctggtgaaagatcacagccagatcaaattgtaagcgattttccaaatgttcaacaacagcttctaaaagagccacagctctgatttcgataaacaaaagcaaagcaaatgcattatcatgaaactcttctatcatcaaactgcctgactgaaccattcccaggtaattttcattcttccactgttgtattatttgaacacactgattttgcaggtttaaaccgtgaatattaaaaagctctgtaagggcgccctccaccgccatccgcaggcagtacttcatatttgctgaaaaaagtctggatcttcaaacacctgcagtaaattcagtagatttacattaggctccacaccttggtctcgcagctgacatcttaatgccagttgtataaaatcatacaaatcagaagccagcagcaaagaaagttcacctccaggtacaagttccggagttcccacagaacatacaacttgcacaaatggacccatattagtaagcgtggcgccaacgtagacatcgcgcataggaggagttaaataatgcattaccagcagccaaaactcaggtagcacgtctttaagaaacgtcaccacctcaaaatctaagccatgcaaatagttccgtaaagactccggaaacaacacggagtaatgaacaagcgacctctgaaacatgctttaggttagcctgaaaaataaaaatatgttaaattaaagatgcctggcaaacgggtggaaaaacaactctacttaaaagcaagcgcgcgactggctgctttgcgcgaacatcgcaaaacacgtcggaatgattaaacaacaaaacactgagctccattcttgagcctggataaagcgtttcagcgccaacaaaaacccctctggcgttcatgtcgcataatgaaaacaatgttcccaaatatccaggaggaatatcaactgctatgtgcaaatataaaagcacaactccatgtggaggtataacaaaattcgcaggagaaaataacacataagcattagagtcgccctcttgtttaggcaacatagccccaggtcccgtaaaatacacataaagagtctcaaaagcagccataatgccttaccagaaaaacagtacaaagccaggcacagcagacacaatctgccgcaagtgcgcacctttaatactgaaaaatagtgacgtaaatggccaaagttcgcctacacaacacaaaaaaaaccccaaaagcccgcgaaaaaaatcacttccgcatatgactcggcataatacggtgttctcacgacacgtcacatccggcgcgcccggctcccacgccgcgccccacttcctcatccgcccaaacttacaagcacgccaaagccacacctccacccaatcaaattacacactacgcccacttcattttaatattggcactagtccagtataaggtatattattagatagggccaagctatttaggtgacactatagaatactcaagctatgcatcaagcttggtaccgagctcggatccactagtaacggccgccagtgtgctggaattcgcccttgtttaaacgcgatcg

SEQ ID NO: 2 - DNA, 34373 bp, Adenovirus A18
  MISC_FEATURE (1)..(34373): Complete Genome
cgatcgcgtttaaacaagggcgaattccagcacactggcggccgttactagtggatccgagctcggtaccaagcttgatgcatagcttgagtattctatagtgtcacctaaatagcttggccctatctaaatatataccttatactggactagagccaatattaaaatgaagtgggtgtggcgatgtactttgattgggtggaggtgtggcctgggcgtgtttgtaagtttgggcggatgaggaagttgggcgcggcgtgggagccgggcgcgccggatgtgacgtgtttaacgccattttaatgcggaaatgatgtgttttgggcgttggttgtgaaaattctgtatttttggcgcgaaaacctgaaatacggaagtgaaaactgatgacgacagtttattataggcgcgtaatatttaccgagggcagagtgaactttgagcctctacgtgtgggtttcggtacgtgagtgttagggaatgtccacgttggcgttcaaagggcgcgtttattgtgtttcgctgggtatttaattccgctgggattgtcaagaggccactcttgagtgccagcgagaagagatttctctgccagctccactcggcgccattatgaggacagaaattactcctttggttctgtcgtgtgaagaggctgatgacatattggaggacttggtgaacaatttttttaccgaggtacccgatgatggggatgatttttatactccttctctttatgaactgtatgatattgatgtggacgttactgacaacgattgtgatgagcaggctgtaagtgcattttttcctgagtcgctacttttagccaccagtgaggggctgttgttgacagaacctccagttatttctccagtagccgctagtgatgggctgttgttgacagaccctccgattctttctccggtatgtgaacccgttgggggtgaatatatgccccgactgcagcctgaagatgagcaggatgtacgcggaatggcattggtgtccgcatctgctatggctgctgttacgcatcatgagaagtttgagttagataatccagaactgcctgggcatgattgtaagtcctgtgaatatcatcggaatagtactggaaataatgacttaatgtgttctctgtgttatctgcgagcatacggcatgtttatttacagtaagtgcattttaaaacggggggtgggttagtttaaaagtacactcaaagtaattttttttttttttactgttttaggtcctgtttcagacaatgaggtagatgactctaatagggacaaacgaccgtcgcctccaacactaggaaacgcagttcctgaaggagtgttaaaacctgttccgcaacggattactggcaggcgtacccatgttgaaagcattttggatttgattcaagaggaagaaagtgaacaaacagagcctgttgatttgtcagtgaaacgccctagatatgattagtggactttgcacacctgtgcaataaaggaagggtggttttggccctttagtgacgtacaataaaattgtttttctgttaagtgttttattggtttcattgggcgtggttaacatggatataaaggtggggtggtagtgctgaggctgatttactttagtatggagttggaagctgtgctgcaaagttatcagggcgttcgtcagctcttacagtatacctctaaaaacacttcaggtttttggagatatctgtttgggtctactttatgcaaagtggtacatagggtaaaagaagactacaggaaggaatttgaaaacatactggccggctgtccagggcttttggcatctttagatctttgccaccactcgatttttcaagagaaagtggtcaaatctttggatttttcatctgcagggcgaacggttgcttctattgcttttttggtaaccgttttagataaatggagccagacgtcccagctgagttgggattacatgctggattacatggcaatgcagctgtggagggcatggctcacgaggagggtttgcatttactcgctggcgcggcctttgaccatgccgcgactgccaacgttgcaggaggaggagctggagcagcgggaccctgcggcggagaagtgaacatggaacaacaggtgcaagaaggccatgcacttgaccctgaggaagggcccagctgtgcagctgttaacattaagcgggaacgggaaacggttcttagtaggctagctgttaatataatgtctcgcccgcgcttagaaactgtgtattggcaggaactgcaaaatgagtttcagcaaggagatatgcatttacagtacaagtatggttttgagcaattaaaaactcactggttagagccttgggaagatattgagagtgctattaaaacttttgcaaagttagctttacgccctgatcgcagctataaaattagtaaaacaataactattgcttcatatgcttacattattggtaatggtgcaataattgaggtggatacaagtgacagggttgctttcagatgtcgcatgcagggcatgggtcctggggtggtggggttgggcggtattacctttattaatgttagatttgctggagacaaatttaaaggtactttgtttgaagccaacaccagccttgttttgcatggtgtttattttcttaattttagtaatacttgtgtggagtcttggattaaggtttccgcaaggggctgtacgttttatggttgtaggaggggtttagtaggcagaccaaaaagtaaaatgtctgtaaaaaaatgcttgtttgagaaatgcgtgctagccttaattgtggagggggatgcgcatattagacataatgcagcttcagaaaatacatgttttgttctagtgaagggaatggctgttttaaggcacaatatggtttgtggagtgtccgatcaatctgcgcgccgttatgttacttgcgctgatggaaattgtcatgccttaaaaactattcatgttgtgagccatgttaaacatcgctggcctgtgtgtgatcataatatgtttatgcgttgttccatgcatttaggcttaaggcgtggcatgtttgtgccttttcaatgtaaccttagtcatacaaatgtattgcttgaacctgaggtgttttctagaataagtttaaatggggtgtttgacctgtctgtggaattgtataaggttataagatatgatgatactcgtcaccgttgtcgacagtgtgagtgtggcagcagtcatctggaactccgccctgttttattgaatgtgacggaggagctgaggagtgaccaccttaccttatcttgcctgcgaactgactacgaatccagtgatgaagacggcaactaagggtaagtgggcggagctaagggcttataaagacaccataaggaaaacttaagctattttgttattttacagcaacatgaatggaactacgcaagacaacgctgcgctttttgatggaggggttttcagtccttatttgacttccaggttgccgtactgggccggagtgcgtcagaatgtgatgggatctaccttggacggccgacctgtggcacctgctaattcgtcaaccttaacatatgcaactgtgggaccttcgcctttggacactgctaccgccgctgcggcctctgcagccgcttccaccgctcgcagtatggcagccgatttcaacttctacagtcacttagcttcaaacgctgtgacgcgcactgcggttcgggaagacattctaactatgatgctggctaagcttgagactctaaccgctcagttagaagatctatcgcagaaggttgaagagcttgctgttgcctctacccgtacccccccagcccaacctgtagcccaataaaaactaaaaaaatcagaaaactgtgttagaatctttattagtgtttgttttttcttacatgataggctctggtccatctttccctgtcactaataacacgatgaatgtgttctagtatgctatagagatgcgattgtatattaagatacattggcataagaccgtctttagggtgaaggtagcaccactgtagggcttcatgttctggggtggtgttataaataatccaatcatagcaagaacgctgggcatggtggtgaaatatgtccttaagtaataagctaattgctagcggaagccctttagtgtaggtatttataaagcgattaagctgggtggggtgcatacgtggagacatgatgtgcatttttgattgtattttaagattagcaatgttaccggccaaatctcttctgggattcatgttatgtaaaaccactaaaactgtgtatccggtacatttaggaaatttatcatgtagtttggaagggaaggcatggaagaacttagaaacggctttgtggctgcccaaattttccatgcactcgtccattattatggcaattggccctacagcggccgcctgagcaaaaatgttttttggatcagaaacatcatagttgtggtccagagttaagtcatcgtaggacagcttaacaaatttagggcgcaatgttccagattggggtattaaagttccttggggtcctggggcataattcccttcacaaatttgcatttcccaagctttaatttcagacgggggaatcatatcaacctggggagcaataaaaaaaacagtttctggagcaggtgtaaccagctgggccgaaagcaagttacgcaatagctgcgatttaccgcaaccagtaggtccgtaaataaccccaataactggttgtaaatgatagtttaacgaggtgcagctgccgtcttctcggaggagtggggccacctcattcatcatttgtctgacgcatgtgttttgcttagctagttcccccaaaagacgctctccgcccagcgatagcaactcctgtaaagatttaaaatttttaagaggttttaaaccatcagccataggcatgtgatctagggtttgcttcagcagctgcagccggtcccacagttctgtaatattttctatggcatctcgatccagcaaatttcctcgttgcgggggttgggttggctgttgctgtaagggatgagacgatgagcgtctaggtgggcgagagttttgtctttccagggtcgcaaggtgcgcttgagagttgtttccgtcactgtaaatggatgcgctcctggttgtgcgctggccaatgtgcgcttcaaactcagacggctggtactgaactgggcgtcttctccctgtgcttcggcaaggtagcattttaacatgagatcataagacagagcatctgcggcatgtcctttagctcgtatttttccttttgagatgcgtttgcagctgggacactgaaggcatttaagggcgtatagttttggagccaaaaacacagattctggagagtatgcatcagagccgcagaagttacaaacagtttcacattcaactgaccaggtcagctcaggacaagatggatcaaaaacaagttttccaccgtgctttttgatgcgtttcctaccttgtgactccataaggcggcgtccttcctctgtcacaaaaaggctgtctgtgtctccgtacacggatttaagaggtctgtccttcaggggtattccgcggtcttcttcgtacaggaattctgaccactctgacacaaaagccctagtccaagcgagtacaaaggaagcaacatgggaaggataccggtcgttacttattaagggattagagctttctagggtgtgtaagcacatatccccttcttcagcatccagaaatgtgattggcttgtaggtgtaagtcacatgacctgaggtttctggtggggggctataaaagggggcgggtccttgatcttcatcgctttcttctgcatcgctgtttacgagcgccagctgttggggtaagtacacgcgctcaaaagcaggcattacatctgtactcaaggtgtcagtttctataaatgatgaggatttgatgtttaagcgacctgctgtaatttccttcataagtccttcttccatttgatcagaaaaaacaatttttttattgtcaagtttggtggcaaaagatccatacagggcatttgaaagcagtttggctatggagcgtagggtttgattcttgtccttatctgcgcgttcctttgcagcgatattaagttgcacatattcacgtgccaggcacttccaggtaggaaagatggtggtgcgttcgtcaggaaggaggcgcactcgccatccacggttgtgcagtgtgattatgtctacactagtaactacttccccccgcaagcgctcattggtccacactaggcgaccgccttttcgtgaacaatatggagggagaatatctagttgattttcatctggaggatcagcatctacagtaaaaatacctggacaaagatttttatcaaaatagtcaatcttacaagtatagttttccagcgccatgtgccattgccgcgcggccaatgcgcgttcataggggttaaggggtggaccccaaggcatagggtgtgttagtgctgatgcatacatgccacaaatatcatatacatatatgggttgttttaatactcctatgtaggtaggataacacctaccgccgcggatgctggcgcgaacatagtcatataattcatgtgacggcgccaggatgttgggtccaaggtttgtccgctgtggtttttcggagcgatatagaatttgcctaaaaattgcatgagagttagaggaaatggtaggtcgctgaaatacattaaagtgtgccgcatgaaggcccacagagttagtaataaagtgggcataggagttgtacagtttttctaccagtgcggctgtaacaagtacatccagggcacaatagtttaatgtttccttaataaggttgtaatttttttctttctttgttttccatagttgttggtttaggaggtattcttccttgtccttccaatactcttccacgggaaaaccgtctgcatttgcacggtaagaaccaagcatataaaattcatttatagctttgtagggacaacatcctttttctacagaaagggcatatgcttgcgcagcttttcttaatgatgtatgagtaagagcaaatgtgtctctaaccattactttcaaatactgatatttaaagtcttggtcattacaacctccttgttcccacagtgaaaagtctattcgttttttatagtgtggattaggaagagcgaaggtgatatcattaaataagattttgccagctcttggcatgaaatttctagaaattttaaagggtccaggaacgtctgagcggctgttaatgacctgtgcggccagaacaatttcatcaaatccattaatgttgtgtcctacaatgtataattctacgaaccttggctgacccttaattgctggagcttttttaaggtcttcgtaggcaaggtcctcaagagcggttagtccgtgttcctgttgagcccaatgaggcaagtggggatttttttgtaaaaaatgtgaccaaatatcattggctaaggatgtttgcaagcggtttctgtaggttcgaaactgttgtcccactttagttttttcggggtttatgcaataaaaagtagtggggtctttttcccactggtcccatccaagttccaaagcaagttgtaacccctggtttacaagacactcatccccagttaatttcatgacaagcataaatgggacaagctgctttccaaatgcccccatccaggtataggtttctacatcataggtaataaaaagacgctcagtgcgaggatgcgagccgatcgggaaaaattggatctcctgccaccaattggaagaatggctgttgatgtggtgaaagtagaaatctcggcggcggacagagcattcatgctgatgtttataaaagcgaccgcagtgttcgcatcgttgcacgggttgtatctgctgaatgaggtgtactcggcgacctcgcgccaaaaagcagaggggaaaatcgaccccttgttttggcgggtgccgttcgtcctctttctcttcttgtgcattgtcactaccgcctggattctggaaagcgaggacggaaagggtgacggtgccccgagagccgcacgtccagatctcagcacgagtggggcggagatgagaaaccagggcgtgcagcttggcgctgtccatggtatcgccaagagagaaaagcaagtctgcggggacagctttcaagttaactgcacacaggcgggtaagagcaggttgaaggtgcaggtgatacttgatttcaaggggagtgccggtggcagaattgattgcatgtagtattccatgggcccggggactaagcaccgttccacgatgaactttttctatgcctttgtttaaaatcggcggcgtggtcgggctcccggaggaagaggtggttcgggtcctgcgtaaagctgaggaaggggtatgtcggcttgtcgctctggcaggggaagatgttgagcacgaagttgactggcccgggcaactacccggcgattgatgtcttgaatttggcggcgttgtgtaaacactactggccctgttgtcttgaacctgaaagaaagttcaacagaatcaatttcggtatcatttactgcagcctgtctaagaatttcctgaacgtcgcctgagttatcttggtaggcaatttctgccattaattgatcaatttcttcgtcctggaggtcgccatgtcccgcccgttcaatggtggcggcaagatcgttagatatgcgactcataagctgtgagaatgcgtttagtccaatttcgttccagacgcggctgtataccactcctccatcgctatctcgggcgcgcatcaccacctgtgccaggtttaattctactagtcgtgcaaacacgccgtagttgcgcaagcgttgaaacaggtagttcaaggtggtggcaatatgttccgagacaaagaaataaagaatccagcggcgcagcgttagctcgttgatgtctcctagggcctcaagacggtccatggcctcgtagaagtccaccgcaaagctgaaaaactgggagttgcgagccgccaccgttaactcctgttctagaagacgaatgagctcggctactgtttcgcgaacttcccgttcaaatgcccatggcgcctcctcctcctcctcctcctcttgtatttccattatttcttcttcttccggcggaggtgggggcgcacgtctctgtcgacggcgtattggcaatcggtcaacaaatctttcaataatttcgccgcggcgacggcgcatggtttcggttacagcttgaccgttttcgcggggacgtaactcaaatgctccacctctaaatcctgtcccactgaaagtagggatggaagcattggaaggggtgttgggcaatgacacagcacttactatgcattttatgatttgttgcgtaggaactccgcgcaaggagctgagtgtgtccatatccaccggatcagaaaatttttcaaggaaggcatctagccaatcgcagtcacaaggtaggctgagttttgtttgatttgcagaatcagaatggtctccaatgctgctaatgatgtaattaaagtaggccgacttaagacgacgaatggttgtaagaagcactgcgtcttttggaccggcttgttggatccgcagacggtcagccattccccaaacttcgctttgacaccgtccaaggtccttgtagtagtcatgcatcaacctttccacatctacttcgcgctgttcgcggtcagccatacgtgtgctgccatatccttgtaacggttgcaacaaggcaagatcggccaccacgcgttcggcaagtacggcctgttggatttgagctagggtggtggcaaagtcatccaagtccacaaacctgtgatatgctcccgtattaatagtgtagctgcagtttgtcattaccgaccagttaacagtttgcgaacctggctgaacagtttctgtgtagcgtaagcgcgagtacgcacgggagtcaaacacatagtcattgcagacacggactagatactggtagcctaccagaagatgagggggaggttcataatataacggccaacgcaaagtggccggagcaccaggagcaaggtcttccagcataaggcggtggtattcatatatgtatcgagacatccatgtgattccggcggcggtggtggttgcccgagcgaactcgcgagctctgttccaaatgttgcgcaggggtaaaaagcgttgaattgtagccatagtctgaccggtcaaacgagcgcaatcttgaatgctctaaacatagagagaataaaagtccgtaagcgactcccttccgtggcttggtggaaaagtcacaagggtaccatagcgaggaaccccggttcgaaaccggcaggatccgctatgagcgtaagtgaggcgcttgcgcgttgaacccggccaaagacccccagacacggagaggagtcttttttttttttatattttcttagatgcatccagttctgcgacaaatgcgaccccagcccagggtaactacggcctcagcagcggtgccgctttcgggccctggcgaacaggaagagcctcagccttccacgttggagttagaagaaggagaaggcatagcccgattgggcgcccattctcctgagcgacacccacgggtgcagctaactcgagacagccgcgcggcgtttgtgcctcgtcaaaacatgtttcgagacaacagcggggaggaagctgaggaaatgagagactgcaggtttagggccggtcgcgagctgcgccgcggatttaatcgcgagcacctgctgcgcgaggaagactttgaaccaaatgagcgttcgggcattagtccagcacgggcccacgtcaccgcagccaatctagtaacagcgtatgaacaaactgttacagaggaacgtaattttcaaaagagttttaataatcatgtgcgcacactaatagcgcgagaagaagtggcaattggtttaatgcatctgtgggactttgtagaagcttatgtacataatccagcaagtaaaccccttactgcccaactgttcttgattgttcaacatagtagagataatgaaacttttagggacgcaatgctaaacatagctgaaccacagggtcgttggttacttgatttaattaacattctccaaagcattgtagtgcaggaacgcagtcttagtttagctgacaaggtggctgcggttaattactccatgttaagtcttggaaagttttacgcccgcaagatttataaaagtccgtatgttccgatcgacaaggaagtaaaaatagacagtttttatatgcgcatggctttaaaggtactaacattaagcgatgatcttggagtgtatcgcaatgacaaaatccacaaagcagtgagtgccagtcgccgcaaggagctgagcgacaaagaactaatgcatagcttgcaaagggcgctcacgggcgcgggaacagaggaggaggagtcgttttttgatatgggagcagacctccggtggcagcccagcgctcgtgctctggaggcggtcggagcaacaaccgctgatgtcaccgacgagtatgatgacgaagaccagtatgaggactgatgggccgtaccttttgatagatgcagcgaccggcgatcaccacggacgggacccctaacctggatcccgcggtcatggcagccatgcaaagccagccttctggggttacagcttcagatgactggacagcggccatggatcgtatcatggctttaacggcgcgcagtcctgaggcttttcgccaacagccccaagcaaatcgattttcggccattttagaagcagtagtgccttctcgcactaaccctacacatgaaaaagtgttaaccattgtgaatgccttgctggatagcaaagctatccgcaaagatgaagcgggtttaatatacaacgctttgttagagcgggtggcgcgctacaatagtactaacgttcaggcaaacttagatcggatgggaactgatgtcaaggaggcgttggcaaaaagagagcgctttcatcgcgacggtaatcttggctcgctggtggcgctaaatgcttttttgagtactttgccagccaacgttccgcgcggccaagaggattacacaaactttattagcgcactgcggctcatggtcaccgaggtaccgcaaagcgaagtgtaccagtccgggcccgattatttttttcaaacttccaggcagggtttgcaaactgttaatttaacgcaggcttttaaaaatttgcaaggcttgtggggagtccgtgctcctgtgggagaccgctcaaccgtgtccagtttgttaacgccaaactcacgcttattgctgttgctgattgccccctttaccaatagcggtagtttaagtcaagattcataccttggtcacctaattactttgtaccgcgaagccattggtcaagcgcaggtagatgaacagacatatcaagaaataactagtgttagccgagcgctgggtcaggaggacactggcagtttagaggcaacattaaactttctcctaaccaaccgtcgtcaacaagtgcctccgcagtatagtttaaatgcagaagaagagcgtatattacgctatgtacagcaatcggtaagcttgtatcttatgcgagagggcgccacgcccagcactgctttagatatgactgcgcgaaatatggagccgtctttctatgcttccaatcgagcattcattaatcgccttatggattaccttcaccgcgcagcggccatgaacggcgaatactttaccaatgctattttaaatccacactggcttccccctcctggcttttatactggcgagtttgatttacccgaaggaaatgatggctttttgtgggatgatgttacagacagtttgtttagtccagcagccattagtcaccatggcaaaaaggaagggggagatgaaggtccgctgattagttctcgatcaagttctccgtttcctagcttaacaagtattaacagtggacgggacaccaggccgcgactaactggggaaagcgattacttaaacgaccctatgctgcttccagtacgggacaaaaactttcctaacaatggtattgagaggctggtagacaaaatggcccgttggaaaacatacgcgcaggaacgccgagaatgggaggagaaacaaccaaagcctgttccgcctcccaggcaacgctggcagcgccgcaggaaaggagcatatgcttctgaaccagaaagcgacgattctgccgatgatagcagtgtgctggatttaggcggcacagggaacccatttgctcacttgcgtccccagggttacataggtcctctgtattaaaatacatatatataataaaagcatacttactaaggccatggcgaccagcgttcgtcttgttgtttttttccgttagctgaaatgaggcgtgcggtggaactccagccagtggcttttgctgaggcgccacctccctcttatgaaaccgtgatggcagcagcggcagcccaaccttctacactggaagcaccctacgtgcctccccgatacttgggtcctacggagggaagaaacagtatccgttattcagaattatccccattgtatgataccactcgggtgtatctggtggataacaaatcatctgacattgcttcgctgaattaccaaaacgatcacagcaactttttaactactgtggtgcagaataacgactactcccctattgaggccggcacgcagactattaactttgatgaacggtctcgttggggtggggatttgaaaacaatactgcgtaccaacatgccaaatgtgaacgatttcatgttcacaaccaaatttaaagctaaggttatggttgccagggaaaaaaataaagaagatccatccaaagatattttgaagtatgaatgggcagaatttgttttgcctgagggtaactattctgaaaccatgaccattgatctaatgaataacgccattattgagcactacctgttagtaggaagacaaaatggagtgctggaaagcgacataggagttaagtttgacacgagaaactttcgcctgggctgggaccccgagactaaacttattacgccgggtgtttacacaaatgaggcgtttcacccagacatagtactcttgcctggatgcggcgttgactttacagagagcagattaagtaacgttcttggcattaggaagcgccagccttttcaggaaggatttattattatgtatgaggacttagagggaggaaacattccggctcttctggatgtaaaaaagtacgaagacagcctgaagaatgagagcgccataagaggagacaattttactgcgttgatgaaagtcgctacaattgaaccagtggcagcggattccaaagggcgcagttacaacttgcttccagacaaaaaaaatactgagtatcgcagctggtacttggcatacaactacggagactcagaaaaaggggtccggtcttggactctcttaactaccccagatgtcacaggcggctctgagcaggtgtactggtcactaccggacatgatgcaagatccggtgactttccgctcgtcgcgtcaagttagcaactacccggtagttgcggcagaactgttaccggttcacgctaaaagtttctacaacgatcaagccgtctactcgcagctcattcgccagtcaaccgcgcttacacacgtgtttaatcgctttcccgagaaccagatattggtgcgcccaccagccgctaccatcactaccgtcagtgaaaacgttcccgccctcacagatcacggaaccctgccgctgcgcagcagtatcagtggagttcagcgagtcaccatcactgacgcccgccgccggacctgtccctacgtttacaaagcactgggcatagtttcaccacgtgtgctttctagtcgcactttttaaaagtgttataacatgtcaattttgatttcgccaagtaataacacagggtggggcttaggttccactcgaatgtatggaggcgccaaaacaaggtccagccaacatccagtgcgcgtgcgcggtcattatcgagcgccttggggagcacatactcgaggacgcacagggcgcactactgtagacgatgttatcgattccgtagtggcagacgcgcgcaaataccgcagacccgctacctccgccgggtctaccgttgatgcagtcattgacgaggtggttgccaacgctcgagattatgctagacgccgcagacgtcttcgccaccgccgtcgtagaccaaccgctgctatgcgcgccgccagagctttggttcgacgcgccagacgcgttgggcgccgagctatgctgcgggcggcaagacgggctgccacacctactggtcgagcacgcaggcgtgccgcagctgcggcggcaagtgctattgcaaacttagctgctcctcggcgaggaaatgtatattgggtgcgcgactcagtaaccggaatgcgcgtaccagttcgtacgcgtccaccacatccttagaagacaaagagtgactcatgtcctgttatgtatgcccagcatgaccaaacgcaagtttaaagaagagctgctgcaggccattgcgcctgaaatatatggcccatcggaagctaacaataccaaacgtgaaatcaagcatgtaacaaaacgagaaaaaaaagaggaagaagctgcagcgctagcagacggcgtggagttcgttcgctcctttgcacccagacgtagggtacagtggaaggggcggcgcgtaaagcgcattttgcggccgggaaccacagtggttttttctcccggagagcgggcggttatgcgaccgctaaagcgcgagtacgacgaagtgtatgccgaccatgacattctggaacaagcggcgcagcagactggggagtttgcctatggaaaaaaagggcgctatggagacaaaattgccatccctttggacgatggcaatccaacacccagtttaaaggccgttactctacagcaagtattgccagtgcttgggccttcggaagaaaagcgtggaattaaaagggaagccgcggatgaattgcaacccaccatgcaactgatggtgcctaagaaacaaaaactagaggatgtactagagcacatagaagtggaccctagcatacagccagatgtcaaaatacgtcctataaaaaaagttgctcccggtttgggagttcaaacagtggacattcaaattcctgtgaaaaccgcgtttggtgaacctatggaaacccaaacttcgccaatggaaacccaaacttcgccaataaaaacagtagcggacgctagcatgcagacagatccttattacctacctaggctttccaaaaaacgttactacagaaaagcaagtgcgcttttaccaaactacgttctacatccttcaatcgtgcccacacctggatatcgcgggtccacttttaaacgccgagctgcgggctccagccgcaggcagggcccatcccgccgcagacgccgacgcaaagctaatttagttccagctgcagtgcgccgcgttgtacgaagggggcgcacactggttcttccgtccgtgcgttaccaccctagcattctctaataagctgcgctgccgtttttgcagatggctcttacttgccgaatgcgcatacccataccaggatacagaggaagaccccgccggaggagagggctggccggtaacggtcgatttcggcggcgtagcatgcgcagacgcatgaagggcggggttctacccctcctaatccctcttattgctgcggccattggggccgttcccggaattgcttcagtggccttgcaggcttctcgaaaaaattaaacaataaaaacttccaacttattactggtactatgactgttttatgcagactaaatggaagacatcaatttttcgtcgctggccccgcggcacggcacgcgtccgtacatgggtacctggaacgaaatcggcaccagtcagctgaacgggggcgccttcaattggaacagtatttggagcggtcttaaaaattttggctccacaattaaatcatatggcaccaaagcgtggaacagccaaaccggtcagatgctaagggataagctaaaagaccaaaacttccaacaaaaagtggtagatggtctggcttcgggaatcaatggagttgtagacatagccaatcaggctgtacaaaaacagattgcaaaccgcttagagccgcggcccgacgaagtaatggtggaggaaaagctaccccctttacaaacggtgcccgcatccgttccatccaaaggagaaaagcgcccacggccggatgcagaggaaaccctagtaacgcacacagtagagccgccgtcatatgaggaagcagtaaaacagggagcctcagtgttgcccaccacgtaccctatgacaaaaccgattttacccatggctaccagggtgtatggaaaaaatgaacatgcgcctatgactttggaaatcccgcctctgccggaacccactattgccgagccagtgctttcgacaccaccagttgcaacagtgacgcgtccagaagtacggccagtggctgtggccagcttacgaaacccgcgatccagtaactggcaaagcacgctgaacagcattgtggggttgggagtgaaatctctcaaacgccgtcgctgctattaaactaaaaaacaaagagtgttaacatcccatctgtgtatacacctcctatgtcagcgccagaggaccaacgcgcgaatcgcagttaccgccgctttcaagatggccactccgtcgatgatgccgcagtggtcttacatgcatatcgccggtcaggatgcctcggaatacctgagtcccgggctggtgcaattcgcccgtgccacggacacctacttcaccctgggcaacaagtttagaaatcccactgtagctcccactcatgacgttaccaccgatcgttctcagcggctgacactgcgttttgtgcccgtggatcgggaagatactgcttactcatacaaggctcgttttacgctagctgtgggtgataaccgcgtacttgatatggctagttcctactttgacattagaggggtactagaccgcggtcccagtttcaagccgtattctggaacggcttacaactctttggctccaaagggcgcgcccaatgctagccagtggctgactactaatgacaacaagtcccacacttttgctcaagcgccttacatagggagctccatcactaaagatggcattcaagtgggaacaaataccgccaatcccccacaaccagtatatgccgacaagacatatcaacccgaacctcaagtaggcgagagtcaatggaacgcgcctttgcctaacaacgcaaaagcagcaggaagggtgctcaagaacaccacacccatgtacccctgctatgggtcttacgcccgagccacaaatgaaaacggaggacaatcaaaaaataacgaaggggtggaaatgcaattttttgcatccgctgctgacaatcaaaatgatcccagtgttgtgctgtacagtgaggacgtaaacctggaagcccctgacacgcacattgtttttaagccagctgtagcagcagacactgttagttcggaactgctactaggtcaacaagcagcgcctaacagacccaattacattggcttcagagataacttcataggactaatgtactacaacagcactggaaatatgggagtgcttgccggacaggcttcgcagcttaatgcagtggtggacctgcaggacaggaatacagagctgtcctaccaacttatgctagacgctttaggcgaccgcagtcggtatttttctatgtggaactcagccgtggacagctacgatcctgatgtgcgaattattgaaaatcatggggtggaagacgaacttcccaattactgctttccactaggcgctgtggggattgtgaattcctacaaaggtgttaaatacgatgcaaatgcctgggcaaaggataacaacaaagcagataataataacttagcaacaggtaacatcttcgccatggaaataaacttgcaggctaatctgtggcgaagtttcttgtactcaaatgtgggcttgtacttacctgacagcttaaaatacactccgggaaacataaagctgcctgataataaaaacacctacgagtacatgaatggccgtgttacagccccggggttggtggatacttatgttaacatcggagctcgttggtcgccagatgttatggataacataaatccttttaaccaccaccgaaacgcagggctccgatacagatctatgctactaggcaatggcaggtttgtgccttttcacattcaggtgccgcagaaattttttgccataagaaacttgctgcttttacctggttcgtacacgtacgaatggaactttagaaaagatgtaaatatgatacttcaaagcaccctaggcaatgacctgcgggtggatggggcaagcattcgctttgacaacatcgcgctgtacgccaactttttccctatggctcataatacggcgtccaccctagaagctatgttgagaaatgacaccaacgaccagtcatttaatgactacctatgcgctgcaaacatgctgtaccctatcccagccaacgcaaccagtgtgccgatttctataccttccagaaattgggcagcatttaggggatggagttttactcgcttaaaaactaaggaaacaccgtcactgggctctggctttgacccgtactttgtgtactcgggaaccattccctatttggacggtacattttatcttaatcatactttcaaaaaggtgtcaattatgtttgactcctctgttagctggccgggaaacgaccgtttgcttacgcccaacgagtttgaaattaagcgttctgtggatggggaagggtacaacgtggctcaatgcaacatgactaaagactggtttcttatccagatgcttagtcactacaacattgggtaccagggtttctatgtgccagaaggctacaaagaccgaatgtattctttcttcagaaactttcagcctatgagtagacaggttgttgacactactgagtacaaagactacaaacaagtaacagtgaagtttcaacataacaattcagggttcgtgggctacttgggtcccaccatgcgggaaggtcaagcttatccagctaactatccctatcccctaattggaaagaccgctgtggaaagcataacgcagaaaaagtttttgtgcgatcgcgtaatgtggcgcatcccattttccagcaattttatgtctatgggagcgcttaccgaccttggacaaaacatgctgtatgcaaattccgcccatgctttggacatgacatttgaggtggatccaatggacgagcccacccttctttatgttttgtttgaagttttcgacgtggtgcggattcatcagccgcaccgcggcgtcatcgaagcggtatacctacgcacgcctttctctgcgggtaacgctaccacctaagaaggcatcttctcagactgctgttatgggttcaagcgagcaggagctcacggccattgttcgagacctaggttgcgggccctattttatgggtacatttgacaaacgctttccaggttttatatcccgcgaccgcttatcctgtgctattgttaacactgctggtcgcgaaactgggggcgtgcattggcttgcttttggatggaaccccaaatctcatacatgctatttatttgaaccatttggattttctgacaagcgtctaaaacaaatatatcactttgagtacgagggactgttgcgccgcagcgcactagcagccactaaggaccgttgcgttaccctacaaaaatcaactcaaagcgttcaaggaccattttctgcagcttgtggccttttttgctgtatgtttttacatgcttttactcattggcctgaccacccaatggataaaaatccaactatggacctacttactggagttcctaactgtatgttacaaagtcctcaggtagtaggcatactgcagcgcaaccaggaggagttgtatagatttttaaacaccctatccccttactttcgtcacaaccgcgagcgcatagaaaaggctacgtcttttactaaaatgcaaatgaactgaaataaacatgttacacagtgtattaataaaaacatttttattaactcattgattcacaaactggtttttattaaaaatcaaacggttcttcgcgaaagtcgccatgattagtaggtagggatagattcctgtactgcagacgcgggtgccacttgaattctggaataacaagcctaggaagcgggccttcaaaattttctctccacagctggcgcgcaagttgcaaggcgcccataacatcaggagcagatatcttgaagtcgcaattgggcccggcattaccgcgggtgttgcggtaaacgggatttgcacactgaaaaaccagcaagcaaggatagtgaatgctggctaacgcccctgggtcggttacttcgccagtgtcaatgttttctacattgctaagggtaaacggcgtcatcttgcagagttgtcgccccatccgtggtacaccatcttgcttgcttaaacactcgcaacgcactggcataagaacgcgtttctgcccctgtcgcatgtgagggtagtcggccaacataaaggcttcgatctgtttaaaagccatttgggcctttgacccctcagagaaaaacaagccacaggactttccggaaaaagagttgcttccgcagccgacatcatggaaacagcagcgagcgtcatcgtttttaatttgcactacattgcgaccccagcgattttgtaccaccttagctttagacggattctctttcaacgcccgctggccattttcactggttacatccatttctaccaggtgctctttacgcaccatttctatgccatgcaaacacctaagctctccctcccgctcggtgcactgatgctcccacacacagcaaccggtgggttcccaggttttatgttgtacgccggcatatgcttgcatgtatccttgcaagaagcggcccattagctcctggaacgttttttgggatgaaaaagttagctgcaatccgcgcttttcttcgccaatccaggttgcgcatatttttttgtatatgccactctgttctggcaaaaatctaaagttggaacgctcgtcatgatccacatggtacttctccataagcatagccatggcttccatacccttctcccaagccgttactaggggctcgttcgcaggatttcggacaacaaaactttcttcactgcttatttgcattgcggcatttgcggggtttcgtttgttgacctccattttttgataagactgcgacccgtctgcatgaggtataatgcgaacagggggcatgctgaatcccattattcctaagactgcctttggcgtttccactactccttcctcttcttcgctgtctaaaacaatctctggcgacggaggaagaggctttgcggacttcatctttcgttttgaaggcagaggcgcaggagctcccatgtcttcctcgctttcggaatccaaaaagtaacggcccatttttggaggcggcggctgaacactgcgatctggggtgcgctccctctgtgagtgttgattgctggccattatttaatcctaggcaaagaaacacatgatggaactccaaccacagggaagtttaaccaccccaagcgctcccgccatctgcactactgctgtcatggaaaaggaaaacagcctacccataccccaggacgcaccggtggagcaggacttgggctacgtgacgccccccgaagagtggcatcaaccagactctcttctaaaccaaaatcagccaaatgaggaacaggcagaaagcaatgaacaaaatgccgggttaaagaatgactacctaggcgagggagatgtcctgcttaagcatctgcagcgacaaaccactatcgtacgcgacgctatagccgaccgcttgtccttgccaatttcagtttcagagttaagcagtgcatacgagcggaatttgttttccccacgtgtgcctccaaagcgacaagccaacggcacatgcgaaccaaatccccgccttaacttttatccagtttttgcagtgccagaagcacttgcaacatatcatatttttttcaaaaatcacaagatccccgtgtcctgccgagccaaccgcacccgcgcagatgaactttttactttaaggtccggcgccgccatacctggtattgtatccttagaggaggtacccagaatttttgaaggcttgggacgtgatgaaaaacgagcggcaaataccctgcaaaaacaaaacgaacaaagtcagtacggaactagcgccctggtagagctggaaggtgacaacgctcggttggcggtactgaagcgaaacgttgcagtgacccactttgcctatccggcgctaaatcttccaccaaaggttatgagcgcagtaatgaatcaggtattaattaagcttgccaaaccaattgatgaacaagcaaacttgcaagatactgaaacaacggacgatggaaaaccagctgtaagcgacgaacagctatcaaggtggttggggacaaacgatagtaaggaactagaacatcggcgcaaattaatgatgggcgctgtactaataactacagaacttgagtgcatgcaccgctttttttctaacagtaccatattgcgtaaaattgaggaatgccttcactataccttccgccatggctacgtgcgccaagcttgtaaagtgtccaatgtggaattaagcaatctagtttcttacatgggcattttgcatgagaaccggctcggtcaaaacgtcctccactctacccttagcggcgaagcgcgcagagactatgtgcgcgattgcatttatctgtttctactgcacacctggcaaaccggcatgggggtgtggcagcaatgcttggaagagcgaaacttgcaagaactacataaactccttgacaagtcgctgagatgcctttggacaggctttgatgaaagaacggtagctgccaacctcgccgacattatttttccagaaaggctattgattaccctgcaaaacggactgcctgatttcatgagccaaagcatgctgcacaattttcgctcttttattttggagcgatctggcatgcttcctagcatgtgttgtgcgctgccttcagattttgtacctatttactttaaagaatgtcctcctcccctgtggagccattgctacctactacaactggccaactacctagcctatcactcagaccttatgacagactccagcggtgagggtctaatggagtgtcattgtcgctgtaatctgtgcacccctcaccgttccctggtttgtaacacagaactactgagtgaaagtcaacttataggaacctttgaaatgcaggggccgcagtctgacaacaacaccgcaacaagtttcaggctcaccccagggctatggacttcagcgtatctgcgtaaatttgagcccgaagattaccacgcccatactatacatttttacgaagaccaatccagacccccaaaggctccgttaacagcttgcgtcattacgcagggaaagattttagcccaattgcaagctattaagcaagcgcgcgaagagtttttacttaaaaaaggacacggagtgtaccttgacccccaaaccggcgaggaactcaatcttccatcaccttcctgtgctaccacgtactcttcacatccacagcatgcccccgaaagccgccaaacaggccattgctctacaacgttcaaagaaacagcagcaacagcaggaaatctgggaggaagaatcttgggagagtcaggcagaggaggacgaggacttggaagaatgggaggaggaggaggaatacaacagcctagaagaggaggaggaaggtatcgaggacggagcgaccgccacaaaaccgtcgctttcaaccgaggcctccccaccgaaccccacagtgagcaaatctcaaaaagccagccgtagatgggacaacactgaaacaagcaccgcagcctcaaactggggtaagaaccgcaagcagacgcgtcggggctactgctcgtggcgggctcacaaaagtaacattgtggcctgcctacaacactgcggggggaatatctcattcgcaaggagatatttgctattccatgatggagtagcaattccaaggaatgtcctgcattactaccgtaatctttacagccccttcgaagcgcccaacaaagaagcaacctgcggcgaccaagcggtccattagaaaaagaagcaacaacaacatcgaagaaagtcctgagacgcgcgagctaagaaaacgcatttttcccactctatatgctatttttcagcagagtcgaggtcaagaacacgaactgaaaataaaaaaccggtccctgcgttcgctaacccgcagctgtctttacctgaaaagcgaagaccagttgcagcgcaccttggaagacgcagaagctctgttcaataaatactgcgctctctcgcttaaagactaaaaaaaaagcccgcgcgcggactttacaggcgggaaagtgacgtcagcgctatgagtaaagaaattcccacgccttacatgtggagcttccaaccccaaatgggtttggccgcaggtgcggctcaggactactccagcagaatgaattggctaagcgccggtcctcatatgatttccaaagtaaacggaattcgcgcccagcgtaaccaaattctgctggagcaggcggctctcacggccaccccgcgtcatcaattaaaccctccctcttggccagctgccctggtataccaggaaaatcccccgcctactactgtacttttaccccgcgacgcccaggccgaagttcacatgactaacactggggcgcagctcgcgggcggcgcacgtcacagtttcaggtgtaaaggtcgctcctggccctaccccacttcaggtataaagcgactgctcatcagagggaaaggtatacagctcaacgacgaggcagtcacatcgtcactgggtctcagaccagacggagtatttcagctcggaggatccggtcgctcctcctttactacccgccaagcctacctaacgctgcagagctcctcatccgctcctaggtccggcggcatcggaactctccaatttgtggaggagtttactccatcagtttacttcaaccccttttcgggttctccaggccactacccagacgccttcatccccaacttcgacgcagtgagtgaatctgtggacggctatgattaatgtctaatggaacagctgacacagctcggctgcgacatttagaacattgtcgccgacttcgctgctttgcccgagacgtgtgtgattttgtttactttgagctccccgaggaacatccccagggacccgctcacggtgtaagggtaacagttgataaaggaattgatacccaccttattaagtttttcaccaaacgtccacttttggtggaaaaggaccaaggaaacactgtactaactttgtactgcatttgttcagttcctgaattacatgaagatttttgttgtcatttgtgtactgaatttaataaattgtagtggcgctttgtcacctgaagaggaacctaattgtcgtccgcctctaactaatatcaaagttgtactttcaaccactcacgttacccttcaatgcaagtttttttctacacaactcacttggacctttaatggaaaaaacgtcgccgaggcaaatttaaagtaccatatcaacaaagaaaacattaccttgcattcgcctattcacctgggatattaccgctgctttgccacaccttgtgtgcaagcgttttttctggctccagttatcaaccctcgtcctgcaactactgctcagcctgaaaaaattaccaagttgatttccaccgctattgctactactgctacaaaaggtacagaagaaatcatatacttttcaaactttacaactaatttacttttaaattgctcgtgctctaactcacttatttcgtggttcgctaacaacaccttctgcaaagctttttttcaaggaacaactttgtattcggctaaacttgaactttgtaacaccagcactccttctaaccttactttgttacctccttttgttgccggccgttatttctgcataggagcaggcgggcatccttgtcagcggcattggaaattagtttttcgtccaacgctggttttacctacgtctgctgatcctactctgtccccaacccctaatttttggcttgaatacagcggacttatagcttttactttatttttactttgcaatttattcttaattaatttttactaacaatgcttcacatcttaattttgttcttttctctaactcccattgtttatgcccaaacagcagagagaccactaaaggttgtggctgaagctggtcataatgtcacacttcctcatttgctgcctggatttaacaaaactggtcatgtaacttggttaatagaaataccagactatggctcagccccttcaaacaaatttgtttttagcggacaaaagctctgtgagtttgccagcaaaaacctaacgtggtcttttccacaattaatttttaaatgtgacaattatgacattaccctattttggcttaaaattgaaaattcggctatttacaatgtaaaaaacacaatagaagccaccgaaagcaatatatactatcagttaacagtaatacaaattaatccgcccaactgtatcatcacttccaaataccttacagaagattattgtcacattacaattaattgtacaaactctcgctatcctaacaaggttatctttaacaatgtcactagatcttattatggttatgctaaaggcagttctacgcttcccaactactttacaaccagctttaatgtttcaggtatcactaaaacatttaagcataactatccttttagtgagctatgtacttatccgtcttccgaaaatttctacaattcaaaagaaacagtaagcaccatagtctttatagtaataattggctttagtgttcttattattctgggtgccctaatttatctttgttggcatcgcaggtttctttatagatctaaatcagaaccttgtgtacaattaaatgcttactagcttttttttgttttacagtatggtgacggttctcttcatctttttatgcctaccaattatttttgcctcttcaacttttgcatccgtcagtcacatcaatcctgactgtttaactccatttacagtgtatttaatttttgcatttgtaactgctacctgcgtctgcagtcttattaccctgctaattacatccttgcaattttttgattattactacgttcgatttgtttatcgcagacaccacccgcattatcaaaacccccaaattgcagcccttcttcagttgcaaccatgaagttaccgttagccttcctttttttctttgtgccaattagggcaacaccttgtgaattgcacaagccatgggattttttggattgctacaccaaagaaacaagctacataggttggatttatggaataatgactggtttggtttttatttccagtgtaatagctttacaaatgtatccgcgccttgattttgcatggaaacgatacactgatgatcttcccgaataccctaatcctcaagttaatctaccacaaaatattgtgtttccagaacccccacgtcctccttctgttgttagttactttaaactcaccggtggagatgattgaagctgatttagaagtcgatggaagaattaccgaacaaagacttctcaccaatcgcgctaggcaacggcagcaggaacaaaaacacaaagagcttcttgatttgcaaaccgtacaccagtgtaaaaaaggacttttttgtttagtaaaacaagctacactcacttatgagttattatcaggcaaagaacaccagttaagctatgtgttgcccattcagcgccaaacctttactgcaatggtgggttctgtacctattaaagtgtcccaacaagcaggagagcaagaaggctttattcgttgcctgtgtgataatcctgaatgtttgtacactttaataaaaacactgtgcggtttaagaaatcttttaccaatgaattaataaaatcacttaccgaaaatctgaaaatatatcgtggtctccgtgtactcttataagttttccctcttcccaactgtcatacttgacagatttacaaatagcaaacttcctccaaaccttaaatggaatatcagattcttcctcccaacccctacccaccatcttcattttttgtagatgaagcgcagcagagtccagtatgctgaagaaactgaagaaaatgatgacttcaaccccgtttacccttttaacccctctgatacaacaattgtgccatttattacgcccccttttaccacttccaatggccttcaagaaaaaccaccaggagtactagcgttgagctacaaagatcccattgttaccgaaaatggaacccttacacttaaattaggggatggaataaaacttaatgcacagggtcaacttacagctagtaacactgctaaggtactagagccccttaccaacaccacacaaggcattaaactttcttggagcgcccccctcgcagtacgggcaagtgcccttacattaattacaaaagcgcctttggttacagcggatgaaagcttaagcttagtaacaacgcctcccattacagtagagtcttctcgtctgggattggctaccatagcccctcttagtttagatggaggtggaaatttaggtttggatttatctgctcccctggacgttagtaacaacaatttgcatctcaccactgaagcccccttagttataaactctggcggtgccctaactgttgctactacggaaccccttggtgttcgtaacaacactctcaccttatctactatggaacccttaacagtaagcgctaatgggttaggaataaacgttaccagtccaatttcggtggccaatggttccttagccttggccgccgctgctcctcttaacaccacaggatccaccttaggtctttctgttacaaatcctctcactatttcaggaaatgcgctcactgtagccactggcaatggtcttcaagtatcggggtctcaattagtagcaagaataggtgatggtttaaggtttgataatggaattataaaggtatatgccgccgggggaatgagaacttcagatggtaaaataattctagatgtcgactacccatttaatgcaaccaccaacttgtctttaagaagaggtttggggctaatttataatcagtctacaaattggaacttaacaactgatattaacactcaaaagggtttaatgttcattggaaatcagatagctattaatgccggacagggacttacatttaataatcaacaactacaggtaaaattgggagctggacttacttttgactcaaacaataacattgtcctagacaatagcagcggcactgcctacgaccctcttacactgtggacaactcccgaccctcttccaaattgcagtcttcttgaagacttagatacaaagctaacattgtgtttaagtaaaaatggcgccattgtacatggcgtggtaagctttgtgcccgttaaaggtgcgctactaaatttacaaaaccctaccagcattggacttcacattctatttgaccaacatggtgtcttacaaacaggaacaccatcagccatagccccacaggcgtactggggatatagacagggacaatccatatcccctactcctgttaccaacgctctgaaatttatgcctaactccagtgcataccccagagctaacggaagtgaaccaaaaagtcaaacgtttacttctacatatatgcaaggcgacatcgctaaacccatgacaatgaaagtctcgtttaatgccgcttctactgttactggctactctttaagctttacatggacaggtatctcaaactaccgtaatcaagctttttcatgcccatcatgttcattttcttacctagcccaagaataaaaaaatactcacaaagaattattatcatattgtttattcttgttttacacaatgcgcgttgttaaacttccgcctccttcccattttattttatacaccaccctttccccctttatagccgaaaacagctgcatgtgcatgtttctacttaggttcttaggtgtcacagtccaaatagtttccttccgagcaaagcgatgatcaatgatagaaacaaacccctcgcccacacagtcacttaggtaactttccccatccagtaccaggtccatgttgacttcctacagaaacaaaaaacagtcagtgtccatcagcagcccaaggattttcacgttgtccatattcttcaaacagcacaggtcggtggtgcataataataccctttagtaatcgctgacgctgaatttctactcggctatgtttcaaggaacgagaagtacttttcataatgatttgtaaagcttttatcattaataaacgggtgcgacgagcacagcagcgcacacgtatctcacttaaatccttacaatagctacagcataataccagcatgttatttaaaaatccatagctaaatgcactgcatccaaaactcattttttctaacaccaatccgacatgaccatcatacattattttaatataaatcaagtgtttccctctaacaaaaatgcttcccatatacagcacctcttttggcataaaccgattcactacttctctataccaaaagcatcttttattaattaaagacccatacactaccattttaaaccaccatgctaacaaagaaccggctgccttacactgtaatgaacctgggcgattacagtgacaatgaataaaccatctctcataaccatgtaataattgggttctctctacatctatggttgcacagcatatacacacgctcatgtacttctttaatataaacatttcatacctacttaaaatcatatcccatggcactggtagctcttgtaatacagtaaagcatacagatgaaggaatgccccttacctcactaacattatgtaaggttaaactgttacactcagaaactgaagaattctcaggtccaaacaaagaagctctcatctccttttcacaaggtggtaacgggtacttcccgtacggtgccaatctgtacggataccgtctgttgcgctgcattatacagcaaagacttccgcgccttctcgtactttaaataacaaaaccacgtacggccgctgcaagcagcgcctcgtcttctttgtctgcgacgattttgctccgtagtaagggcgtaatataaccactctcgcaaacacagcagaattctttcagcttcaggtgttatcattaggcgatgtcctttaatgcgtagcagagtatccacacaggtcgcatgggctaaaccaagccatgctatgcaagcagccgtgtcccgacttacaggaggaggaggaatacaaggcagaggcataaaaacttaatcaagacggtcagcaaggatttgaatgcgtaaatctcgcaggtggcagcgatcgcctccgctgtgctggtgaaagatcacagccagatcaaattgtaagcgattttccaaatgttcaacaacagcatctaaaagagccacagctctgatttcgataaacaaaagcaaagcaaatgcattatcatgaaactcttctatcatcaaactgcctgactgaaccattcccaggtaattttcattcttccattgttgtattatgtgaacacattgattttgcaggtttaaaccatgaatattaaaaagctctgtaagggcgccctccaccgccatccgcaggcagtacttcatatttgctgaaaaaagtctggatcttcaaacacctgcagtaaattcagtagatttacattaggctccacaccttggtctcgcagctgacaccttaatgccaattgtataaaatcatgcaaatcagaagccagcagcaaagaaagttcacctccaggtacaagttccggagttcccacagaacatacaacttgcacaaatgggcccatattagtaagcgtggcaccaacgtagacatcgcgcataggaggagttaaataatgcattaccagcagccaaaactcaggtagcacgtctttaagaaacgccaccacctcaaaatttaagtcatgcaaatagttccgtaaacactccggaaacaacacagagtaatgaacaagctgcctctgaaacatgctttaggttagcctgaaaaataaaaatatgttaaagtaaagatgcctggcgaacgggtggaaaaataactctacttaaaagcaagcgcgcgactggctgctttgcgcgaacatcgcaaaacacgtcggaatgattaaacagcaaaacactaagctccattcttgagcctggataaagcgtttcagcgccaacaaaaacccctctggcgttcatgtcgctcaatgaaaataatgttcccaaatatccaggaggaatatcaactgctatatgcaaatataaaagcacaactccatgcggaggtataacaaaattcgcaggagaaaataacacataagcgttagaataaccttcttgttcaggcaacatagccccaggtcccttaaaatacacatacagagcctgtaaagcagccataatgccttaccagaaaaaacagtacaaatcccaggcacagcgaacacaatctgccgcaagtgttcgcctttaatactgaaaaatagtgacgtaaatgaccaaagttcacctacacaacacaaaaaacccccaaaagcccgcgaaaaaatacacttccgcatatgactcggcacaatacagtgttctcacgacacgtcacatccggcgcgcccggctcccacgccgcgcccaacttcctcatccgcccaaacttacaaacacgcccaggccacacctccacccaatcaaagtacatcgccacacccacttcattttaatattggctctagtccagtataaggtatatatttagataggggccagtgaattgtaatacgactcactatagggcgaattgggccctctagatgcatgctcgagcggccgccagtgtgatggatatctgcagaattcgcccttccttaattaacctgcag

SEQ ID NO: 3 - DNA, 34044 bp, Adenovirus A31
  MISC_FEATURE (1)..(34044): Complete Genome
cgatcgcgtttaaacaagggcgaattccagcacactggcggccgttactagtggatccgagctcggtaccaagcttgatgcatagcttgagtattctatagtgtcacctaaatagcttggccatcatcaataatataccttacactggacttgagccaatattaaaatgaagtgggcggagtgaatagttaattgaccgtaggcgtggtttgcaagtttgccgaagccggatgtgacgcgtgtgggagccgggcgcgccggatgtgacgcgttagtcgccatttttataggaaatgacatgttttttgggcgttgttgtgtaagttttgtgtttttggcggtaaaagtgatttgcggaagtgaaaactgtttacgtcagttttattataggcgagtaatatttaccgagggcaaagtgaactttgagccactacgtggtggtttcgatacgtgagcgatagggaaactccacgttggtgtccaaaggacacgtttattgttctgtcagctgggtatttaatcccgctgcgtttgtcaagaggccactcttgagtgccagcgagaagagttttctctgcgagctgacatacggcgccattatgagaactgaaataactcctttggtgttgtcctatgaagaagccgatgacatattggagcatttggtggagaacttttttaacgaggtacccagcgatgatgatttttatgttccctcgcttcacgaactgtatgatattgatgtggagtctgccggtgaggattctaatgaacaggctgtgaatgatttttttccggaatcgtttattttagctgctgctgaaggggtaatattaccggagccccctgtgctttctcctatttgtgaacctattggtggtgaatgtatgccacagttgtgttctgaagatatggatttgttgtgttatgaggcggcttttccctgtagcgactctgaaggtgagcaagacgaaaacggaatggcgcatgtttctgcagctgcagcggcggctgctgctaatagagaacgtgaggagtttcagttagaccatccggagttgcctggacatgattgtaagtcctgcgagtaccaccggaatagtactggaaacactgacttaatgtgctctttgtgttatctgcgagcctacagcatgtttatttacagtaagtgcgctatttggacggtgggaggtgtatttttttatttgttcttagcagtaaagacttttttgtttttaggtcctgtttctgacaacgaaccggaacctgacagcactacggatgacaatgagagaccgtcgcccccagaactgggagatgtagttccggaaggagtagtgaaacctgtacctcagcgggtgactgggaggcgacgtgctgtggaaagtattttggatttgatccaagaggaagaatgtgaacaaacagtgcctgttgatttgtcagtgaaacgccctaaatgtaattaatgaactttgcacacctggcaataaaatgggagttttgtgtgagtcacgtataataaactgtttgcgtgttttatttgggcgtggttagtaggcatataaaggtgggttggcgctgcctagcatgagatactgaagaatggagctagaagctgtgttgcaaagttttcagagcgttcgtcagcttctgcagtatacctctaaaaacacttcaggtttttggagatatctgtttggttctactttaagcaaggtggtacatagggtgaaggaagattacagagaggaatttgaaaacatattggccgactgtccagggcttttagcttcattagatctttgccaccactctgtttttcaggaaagagtggtcagatctttagatttttcatcttctggccgaacggttgcttctattgcctttttggcaaccgtgttggataaatggagcgagaggtcccacctgagctgggattacatgctggattacatggcaatgcatttgtggagggcatggctgaagaggagggtttgcatttactcgctggcgcggcctctaaccatgccgccgttgcaggaggagcagcagaacactacgacggaggagtaaacatggaaccacaggtgcaagaaggccatgaacctgaccccgacgaagggcctagttgtgcagttgttaaaaagcgggaaagaaaagaaagtttaaaggaaactgtccttaataggctgactgttaacctaatgtctcgcccgcgcttggaaactgtatattggcaggaattacaggatgaatttaagcagggacacatgcatctacaatacaagtacagttttgagcagctaaaaacccactggctagaaccatgggaggatttagagtgtgctattaaagcttttgctaaagtagctttacgccctgactgtacttataaaatctctaagacagtaactattacgtcatgtacgtacattataggcaatggggcagtagttgaggtggacactagtgatagagttgcttttaggtgtcgtatgcagggcatgggtccgggggtggtaggtttggatggcattacatttatgaatgttaggtttgctggagaaaaatttaagggcattatgtttgaggctaacacaagtgttgtgttgcatggtgtgtactttcttaactttaataacacgtgtgtagagtgttggaataaggtttctgccaggggttgcactttttatgggtgttggaaggccttggtaggtaggcccaaaagtaaaatgtctgtaaaaaagtgcttgtttgagaaatgcgtgcttgctttaattgtagaaggggatgctcacattagacataatgcagcttcagaaaatacctgttttattctactgaagggaatggctattttaaagcacaatatggtttgcggggtgtctgatcagacaatgcgacggtttgtcacctgtgctgatggaaattgtcacactttgaaaactgttcatattgtgagtcatgctagatattgttggcctgtgtgtgaccataacatgtttatgcgctgcacaatacatttgggtctccggcggggtgtgtttagaccttcccagtgtaactttagtcattcaaatgttatgttggagcccgaggcgttttccagagtgagtttaaatggggtgtttgatttatctgtggaattatgcaagattatcaggtatgacgatgctgcccgtcatcgctgccggcagtgcgaatgtggcagtagtcatctagaacttcgccccgtcatgctgaatgtaactgaggagctaagaagtgaccatcttaccctgtcttgtctgcgaaccgactatgagtctagcgatgaagacaactaaggtaagtgggcggagttatgtgggactataaaatgcttaaaggaattgtaaagttgtttttgttattttggcagcgcaatgaacggaactgctggggacaacgctgtgctttttgatggaggggttttcagcccttatttgacgtcaaggttaccgtattgggccggagtgcgtcagaatgtggtaggatctactccagacggacgacctgtagcgcctgcaaattcgtcaacgttaacctatgcaactgtgggaccttcgccgttggataccgccgccgccgctgcagcttctgcggcggcttgtacggctcgcaatatggcagctgattttagtctctacagccaattgacatcgaatgccgcaatgcgcactgcagtccgaggagacattttaactgttatgcttgcaaagcttgagaccttaactgctcagctagaggagctgtcgcataaggttgaagaattagctgatgctaccactcccaccctaccacaacctgttagtcaataaaaaaagctttaaattgtatgctgtttgactgtttattgatgtttgttttttctgacatggtaagctctggaccatcgttccctatcattaagaacacggtgaatgtattccaatattttgtaaaggtgggcttgtatgttaaggtacattggcataagaccatctgtgggatgcaggtaggaccactgtagggcttcttgctcaggggtggtgttgtaaataatccaatcgtagcaacagcgctgggcatggtggtgaaatatatctttaagcaacaagctgattgctaagggaagacctttagtgtaggtatttataaagcggttaagctgggtggggtgcatacggggggacataatatgtagttttgattgtattttgagattggcaatgtttcctgccagatctctcctcggattcatgttgtggagaaccacaaaaacagtgtagccagtgcatttggggaatttatcatgaagtttggaaggaaaggcatgaaaaaatttggagacgcctttgtggcttcccagattttccatacactcatccattattatagcaattggcccgcaagcagcggctttagcaaaaatgttctttggatcagaaacatcatagttgtggtctaacgttaaatcatcgtacgagagcttaacaaatttagggcagagcgttccggactgtgggataatggttccctggggtcccggggcataatttccctcacaaatttgcatttcccaagatttaatttccgaaggcggaatcatgtccacttggggaacaataaaaaaaacagtttctggagcaggtgtgaccagctgggcggaaagcaagttacgcaacaactgagatttcccacatccagtaggtccataaatcaccccaataactggctgcaagtgatagtttaacgaggtgcagctgccgtcgtcgcggagaagcggagccacatcgttcatcatttgcttgacttgcatgttttgcttgacaagttccctgagaaggcgttcaccgcccaaggagagcaactcttgcaaagagttgaaagtttttaatggtttcagaccgtcagccattggcatgtggtccagggtttgttttaacagttgcaagcggtcccatagctgagttatgttttctattccatctcgatccaacagacttcctcgttgcggggattgggctggctgttgctgtaaggaacaaggcgatgagcatccaagtgcaccagggttttgtccttccatggacgtaaggtgcgcgtcagggttgtttcggtcacggtgaacggatgcgcccctggttgggcgctggccagcgtgcgctttaagctggtgcggctggtgctgaagtgtgtgtcttctccctgtgcttcggcaaggtagcattttaacatgagatcataagataaggcatccgtggcgtgacctttagcccgtattttcccctttgaagtgctgccacaatcaggacactgaaggcatttaagggcgtacagtttcggagccaaaaaaacagactctggagcgtaagcatctgcaccgcagttagcacaaacagtttcgcattccaccgaccaggtcagctcaggataagatggatcaaaaacaagtttccctccatactttttgatgcgtttcttaccttgcgactccataaggcggcgtcctttctctgtgacaaaaagactgtctgtgtctccgtatacagatttaatgggtctgtcctttagggctattccacggtcctcctcgtacagaaactctgaccactctgacacaaaggccctagtccaagccagtacaaacgaggccacatgggaagggtaccgatcgttactaattaaagggttggaactttccaaggtgtgtaagcacatatcctcttcttcagcatctatgaatgtgattggtttgtaggtgtaagtcacgtgatcagagttccctggtggggggctataaaaaggggtgggacactgatcttcatcgctgtcttcggcttcgctgtttacgagcgccagctgttgcggtgagtacgcgcgctgaaaggcaggtaacacatctgtactcaaagtatcagtttctataaacgatgaggatttgatgtgcaaacggcccgctgcaatttcttttatgagcccctcttccatttgatcagaaaaaacaatttttttgttatctaattttgtagcaaaggatccgtacagggcgtttgaaagtaacttggctatagatcttagcgtttggtttttgtccctgtctgcccgttcttttgcggcgatattgagttgtacatattcacgagcaatgcatttccaagtgggaaaaacggtggtacgttcgtctggtaataatcgcagacgccacccgcgattatgcagtgtaactaagtctacactggtgaccacttcgccgcgcaagctctcattagtccaggctaaacgaccgccttttcgagagcaaaaaggaggaagaacatccagctggttctcgtctggaggatcagcatccacagtaaaaatgccaggacataaaattttatcaaaataatcaattttggaagtaagattttcaagtgccacctgccactgccgtacggctaatgctcgttcgtaagggttaagaggaggaccccaaggcatagggtgtgtaagggctgatgcatacatgccacaaatatcatatacatatatgggttcctgtataacacctatataggtaggatagcacctgccgccgcgaatgcttgcgcgaacatagtcgtatagttcgtgcgaaggcgccaaaaggttagggcctaaatgtgtgcgttttggtttctctgcgcgatacaaaatttgtcgaaaaagcgcatgagagttagaggagatggtgggacgttgaaacacattgaagtgtgcctgctgaagacccaccgactgattaacaaactgggcgtaggaactgcgcagtttttctaccaataaggtcgtaacgatgacatccagggcgcaatagtttaaagtttccagaataagattgtaatttttttctcctttttttttccatagttcttggtttaggaggtattcctgtttatccttccaatactcctctacagggaaaccatctgcatcagcgcggtaagaaccaagcatgtaaaattgatttatggccttgtagggacaacaacctttttctacaggcagggcataagcttcagcggcctttcttaaagatgtatgagttaaagcaaaggtgtccctgaccattacttttaaatactggtatttaaagtcctggtcgtcacatcctccttgctcccacagcaggaagtcagtgcgctttttgtagtaaggattagggagagcaaaagttatgtcattaaataaaattttaccagctcttggaataaaatttctagagattttaaatggcgccggtacatctgaccgattgtttatgacctgcgcggcaagaactatttcatcaaatccattaatattgtgccccactatgtataactctagaaatcttggctgccccttgatgacaggagcttttttaagctgttcaaaggtcagatcgtcaggactaaccagaccattttgctgttgcgcccactgatgcaactgcggattgttttgtaaaaaagtattccagaggttagcggctaaagacgtttgcaagcgatttctgtaggtacggaattgctgaccgaccttcattttttctggggtaatacaatagaaagtagaggagtctttctcccattggtcccatccaagttctaaggcaagttgtaatgcgtgcgctacaaggctactgtccccagacagtttcattaccagcataaatggtacaagttgctttccaaacgagcccatccaggtgtaggtttctatgtcataggtaataaaaagacgttcagtgcgaggatgcgaaccgaccgggaaaaactggatctcctgccaccagttggaagagtgggcgttaatgtggtggaagtagaaatctcgccggcgagcagagcattcatgtcgatgtttgtaaaagcgtgcgcagtattcgcatcgttgcatgggctgtatgtgttgaatgaggtgcacctgacgaccgcgcaccaaaaagcgcatgggaaaatggatgccacttcttggcagttgccgttcgttgtcttcctgttctgttgcatcgttgtcaccgtttggatccttgaaagtgacaacggaaagggtaacggcgcctcgaccgctgcacgtccatatttcggctcgagcggggctgaagcaggaaatcaaagcttgcagtctggaactgtccatggtatcactcataaaggaaagcgcgtctgcggggaaagcttgcaagttaacttcacaaaggcgggtaagagcaggccgtaggtgaaggtgatacttaatttcaagcggagtgccatcggtagaatctattgcgtgcagtgtgccgtaagcccgaggtgcaattactgttccgcggtgagcaacacgcctgcttaaaagcgacggcgtgcaggaactgggacttccgcttctgcgggagcttgaggcagtcgtatgtcggcctgacgttctggtagtggaaggtgctgagcccgtagttgactggcatgggcgacgacacgacgattgatgttctgaatttgccgacgttgtgtaaacaccactggtcccgttgttttgaacctgaaagaaagttcaacagaatcaatttcagtgtcatttactgcagcctgcctcaaaatttcctgaatatcccctgagttatcttggtaggcaatttctgccattagttgatcaatttcttcctcctggagatctccatgacccgctcgttcaatggtagctgcaaggtcattagatatgcgtcccataagctgtgaaaatgcgttaagtccagtttcgttccagacgcggctgtacacaactcctccgtcgctgtctctggcacgcataaccacttgcgccaagttaagttccacgaagcgcgcgaacacaccgtagttgcgtaaacgctgaaacaggtagtttaaggtagtagctatgtgttctgaaacaaaaaaataaagaatccaccgacgaagcgtgagctcgttgatgtctcccagagcttccaaacgttccatggcttcgtagaagtcaactgcaaaagtaaaaaactgggagtttcgagctgcaacagttaattcttcttctaaaagacgaataatttcagccaccgtgtggcgcacttcaagcgcgaaagcctccggggcttcttcttcctgttcctcttctacttccattgtttcttcttgaaccgcgggcggagagggtagccttcttcgtcgccggcgaacgggcagcctgtctacaaacctttcaatcatttcgccccggcggcggcgcatagtttccgtcactgctcgaccattttcacgcgggcgaagctcgaaaagtccaccccttagttgtagggtaggaaatgcgttgcgaggtgcgtttggtagcgacacagcacttactatgcattttatgatttgttgcgtagaaactccgcgccaggacctaagcgactgcatatctactgggtcggaaaacctttcaaggaaggcgtcaatccagtcacagtcacaaggtaggctaagttttgtttgctgtgaatcaccgggatgttgaactatgttgctaatcatgtaattaaaataggctgttttaagtctgcggatggttttaagaagcaccacgtcttttggtccggcttgttgaactcgcaggcggtctgccattccccacacactactttgacaacgtccaagatctttgtagtagtcgtgcatgagcctttccactggtatttcgcggtcttggcgatcagccatgtgcgttgcaccatagccttgtaatggttgcaataaagctaaatctgcaactacccgttcagcaagtactgcctgctgtatttgggtaagagtattttcaaagtcatccatatctacaaagcggtggtaagctcctgtattaatggtgtaactgcagttggtcattactgaccaattaacagtgtggacacctggctgtatggtttctgtgtatcgtaagcgcgagtaagctcgagagtcaaaaacataatcgttgcaagcgcgcaccaaatactgatagcccactagaaaatgaggaggaggttcttgatataacggccaccgaagtgtagccgccgcaccgggagcaaggtcttctaacatgaggcggtggtattcatatatgtatctggacatccacgtgatgccggcggcagtggttgttgcccgggcaaactggcgaacttggttccaaatgttgcgcaggggtaaaaagcgttcaatggttgggacgctttgaccggtgaggcgtgcgcagtcttgaatgctctagatgtaaagaaaatgaaagtcggtaagcgactcccctctgtggcctggcggaaaagtcacaagggtaccacagcgaggaaccccggttcgaaaccggcaggatccgctgtgagcgtatatagggcgtctgcgcgtagaacccagccaaagacccccagacacggagaggagtcttttgcttttttttagatgcatcccgtcctgcgacagatgcgacctcaatccagggcacccacgccctcaggaccaatagcgcttgggggctctggcgaacctgaagagccttccacgttggagttggaagaaggagaaggcttagcccgtctgggcgctcactctcctgagcgacacccaagggtgcagcttactcgcgatagtcgtgcggcgtttgtgcctcggcaaaatatgtttcgagataacagcgggcaggaggctgaggaaatgagagactgtagatttagggccggccgcgagctgcgttgcggacttaatcgcgagcgactgctacgagaagaagattttgagcctgatgaacgttctgggattagtcccgcgcgagctcatgtttccgcggccaacttagtgtcagcctatgaacaaaccgttacagaggaacgtaattttcaaaaaagctttaataatcacgtgcgcacgctaattgcgcgtgaagaagtggctattggtttaatgcatctttgggactttgtggaagcgtatgtacataatccagcaagcaaacctttgactgctcagctttttttgatagtacaacatagtagagataatgaaacatttagagacgcaatgcttaacattgctgagccacagggtcggtggctacttgatttaattaatatcttgcaaagtattgtggttcaggaacgcagtctcagtttagcagacaaagtggctgcggtcaattattccatgttaagtttgggaaagttctatgctcgtaagatatacaaaagtccatatgttcccattgacaaggaagtaaagatagacagtttttacatgcgcatggcgttaaaggtactaacattgagcgacgatttgggagtataccgcaatgatcgaatccacaaagcggtgagcgcaagtcgtcgaagagaacttagtgacaaggaacttatgcatagcctgcaaagagcgctaacgggagccggaacagaggacgagtcctttttcgatatgggcgcagatctaaagtggcagccaagcgcccgcgccctggaggcggctggccaggataatgatgatgatgatgatgatgacgaagaccagtacgaggactgaccgggccgtaccttttgttagatgcagcgaccggctatcatcacggacggggcccgtaacctggatcccgcggtctcggcggccatgcaaagtcagccttctggagttacggcttcagatgactggacagcggccatggatcgtattatggctttaacggcgcgcagtcctgaggcttttcgccagcagccgcaagctaatcgattttctgccattttggaagcagtagtgccgtctcgaactaatcccacccatgagaaagtgctaaccatagtgaacgctctgttggacagcaaagctatccgtaaagatgaggctggtcttatatacaatgctcttctggagcgcgtggcgcgctacaacagtaccaacgtacaggctaacttggaccggatgggtatggatgtaaaggaagcacttgcgcaacgagagcgatttcatcgcgacggcaatcttggctccctggttgcgctaaatgcctttttaagctctcagccggctaatgttccgcgcggtcaagaagattacacaaactttataagcgctttgcgcctgatggttactgaagttccacaaagcgaagtgtatcagtctggtcctgattatttctttcaaacttccaggcaggggttgcaaaccgtaaatttaagccaagcttttaagaatttgcaaggcctgtggggggtacgcgctcctgtgggtgatcgctcaactgtctccagtctgttaacgccaaattctcgattattattgttgttaattgccccttttaccaacagcgatagtttaagtagggattcgtatctaggtcacttaattactttgtatcgcgaagccattggtcaagcgcaggtagatgagcaaacgtatcaagaaataaccagcgtgagtcgcgctctgggacaggaggatacaggcagtttggaagccacgcttaactttttactaacaaaccgccgtcagcaagtgcctccgcaatacagtttgaatgcagaagaagagcgcatactgcgctacattcagcaatcagtgagcttgtatttaatgcgcgaaggcgcaacgcccagtgccgctttagatatgactgcgcgcaacatggagccgtcattctactcttccaatagagcatttattaatcgtttaatggattaccttcaccgagccgcggccatgaacggagaatactttaccaacgcgattttaaatccgcattggttaccacctcctggtttttatactggagaatttgatttaccggagggaaacgatggctttttgtgggatgatgttacagacagtctgttcagcccggcagccattggtcaccatggtaaaaaggagggagcagatgaaggtccgttactaagctctcgggcaagttcgccgtttcccagcctaagcagtattaacagcggtcgtacaacaagaccgaaactatcaggggaaagcgagtatttaaatgatcccctgttacgtccagcacgcgacaaaaattttccaaataatggcatagagagcttagtagacaaaatgtctcgttggaaaacgtatgcgcaagagcggcatgaatgggaagagagacaacccaaaccggtgccccctccgagacaacgctggcaacggcgtaaaaaaggagcgcatgcgcttgacgaaggaagcgatgactcagcagatgacagtagtgtgctagacctaggagggacagggaacccatttgctcatttgcgtccgcaaggtcaactagggcggttgtattgaacaaaataaaagcactcttaccaaagccatggcgaccagcgttcgtcttatttgttttttccgttagctgcaaaatgaggcgcgcggtggaactgcagacagtggcttttcccgaggcaccaccaccctcttacgaaaccgtgatggcagcagctcaaacttccgcactggaagctccctacgtgcctccccgctatttggctcctacggagggaagaaatagcattcgttattcagaattgtcaccgttatacgataccactcgagtgtacttagtggacaacaagtcttctgatatcgcttctttaaactaccaaaatgatcacagcaactttctaaccactgtagtccaaaacaacgactattcccctatagaagccggtacacaaactattaattttgacgaaaggtcccgatggggcggtgatttgaaaactattttgcatactaacatgcccaacgtaaatgattttatgtttacaactaaatttaaggccagggtaatggtgtctagaaaaaaagatagtgaagaccagtccaaagacattttgaaatacgagtgggcagaatttgtgttacccgaaggtaactactcggaaaccatgactatcgacttaatgaacaacgcaatcatcgagcattacttgcgagttggccgtcagaacggtgtgctagaaagcgacattggagttaagtttgacaccagaaactttcgcctgggttgggaccccgaaactaaattagtgactccgggagtgtatactaacgaggcttttcatccagatatagtattgctaccaggatgcggagtggacttcacggagagcagattaagcaacatgctgggaatcagaaaaagacagccttttcaggagggttttgttatcatgtatgaagacttagaagggggaaatatcccagcgcttttagatgttaaaaaatacgaagacagcttgcagccagacaacaccgtaagaggtgacaactttattgccttaaacaaggccgcaaaaatcgaagcagtcgaggctgattccaaaggccgaagttacaacttgcttcccgacaaaaaaaatactaagtaccgtagctggtatttggcatacaactatggagatccagaaaaaggtgttcgttcttggactcttctaacaaccccagacgtgacaggcggttccgagcaggtctattggtcgcttcccgatatgatgcaagatccggtgacttttcgctcctcgcgtcaagtcagcaactatccggtagttgcggccgaactaatgccggttcacgccaaaagcttctacaacgaacaagccgtctactcacagcttatccgccagtcaaccgcgcttacacacgtgtttaatcgctttcccgagaaccagatactagtgcgtccaccagctgctaccatcactaccgtcagtgaaaacgttcccgctctcacagatcacgggaccctgccgctgcgtagcagtatcagtggagttcagcgagtcaccatcactgacgcccgccgccggacctgtccttacgtttacaaagcactgggcatagtttctccacgagtactttctagtcgcactttctaaaaagtgtacaaacatgtccatcttggtttcgccaagtaacaacacgggctggggattgggagctggccgcatgtacggaggagctaaaaccaggtccagccaacatccagttcgcgtccgcggacactatcgagcgccatggggagcacatacccgcggacgcactggtcgcaccactgtggacgatgttatcgactcggtcgtagccgatgctcgaaaataccgtccaccagccaatacagcagggtctaccgttgatgcggtcattgatgaggtagtggcaaacgcacgagcttatgccagacgtcgcagaaggccgcgtcggcgccgacctactgctgctgtgcgtgcggctagagcgttagtgcgacgcgctagacgcgtcggacgtcgagctatgctgcgagcagccaggcaagctgtaacgcctgccggtagagcgcggagacaggccgcagctgcggccgcaacagctattgccaacctagccgctcccagacgaggaaatgtgtactgggtgcgcgacgcggtaactgggactcgagtcccggttcgtacgcgtccacctcacccttagaagacaaagagttgattgataacctgttatgtatgcccagcatgaccaaacgcaagttcaaagaagagctgctgcaggccgtcgcgcctgaaatatacggcccagcggattacattaccaagcgcgaaatcaagcatgttaaaaaactggaccaaaaaaaagaggaagaaatggccgcagcgctagcggacgaagtcgacttcgtgcgctcctttgcgcccagacgtagaatacagtggaaagggcggtcagtaaagcgagttttgcgacccggcactacaatagttttttctcctggggagcgaacggctatgcgccccctcaagcgcgaatacgatgaagtgtatgccgatgatgacattttggaacaggctgcccaacaggctggtgaattcgcctatggaaaaagaagccgttacgacgacaaaattgctattcctttggacgagggaaatcccacacccagtttaaaggctgtcactttacagcaagtattacctgtgctcgcgacctcagaagaaaagcgaggcataaaaagggaagctatgaatgacttacagcccacaatgcaacttatggtgcccaagcggcaaaagttagaggacgtactagagtacatgaaggtggatcccaacattcagccggacgtaaaaatacgtcccataaaaaaagttgccccaggattaggagtccaaacagtggacatccaaattcccgtacaagctgcgcaaagtaaaactatggaaacccagacttcgccaataaaaacagcagtggacagcggcatgcaaaccgagccttggtacccgccaacttttacaagaaaaaaacgccactacaaacaaacaaacgcgctcttgccagaatacgtgctacatccttccattgtgcccacgccggggtatcgcgggtcaactttccagcgcagagccctagtttatagtcgcagaagaactccgtcgcgacgcagacgtcgacgcagagccaatttagctccagcatcagtacgccgcgttgtacgaaaagggcgcacactgacgcttccatctgtgcgttaccaccctagcatactctaataagctgcgctgccgttttacagatggctcttacttgccgaatgcgcatacccattccaggatacagaggaagatctcatcggaggagagggctgaccgggaacggtcgatttcggcgacgtagcgcgcgcaggcgcatgaagggcggggtacttcccctgctaattccacttattgccgcggccatcggagccgtacccggaattgcttcagttgccttgcaggcttctcgaaaaaattaaattaaaatcaaaagaaataaaaaaggaataacttccaacttattactggtactgtgactgttttatgcagactaaatggaagacatcaatttttcgtcgctggccccgcgacacggcacgcggccgtatatgggcacctggaacgagatcggcaccagccagctgaacgggggcgccttcaattggaacagtatctggagcggtcttaaaaattttggttccacaattaagacatatggctccaaggcgtggaacagccaaaccggccagatgctaagggacaagttaaaagaccagaacttccaacaaaaagtggtagacggtctggcttctggaatcaatggagttgtagacatagctaatcaagctgtgcagaaacagattgccaaccgtttagagccgcgacccgacgaagtaatggtagaggaaaagttaccgcctctggaaacggtgcccggatcagttccgtccaaaggagaaaagcggccgcggccagatgcagaggaaactctagtcacgcacaccatagagcccccttcttatgaggaagcagttaaacaaggagcagctttggcacctactacttatcccatgaccaagcctattctacccatggctaccagggtgtatgggaaaaatgaaaatgcgcctatgactctcgagattcctcccttgccagaacctactgttgcggaacctgtggttactgctccgattgtttcaactgtatcgcgtccagaagtgcggcctgttgccgtagcaagctcacgaaacccgcgatccactaattggcaaagcaccctaaacagcattgtgggactgggagtaaagtctttaaaacgcagacgctgctattaacattaaacaaaacatagtgttaactcccgtctgtatacgcctctatgttagcgccagaggaccaacgctcgaattgcagttattaccagcgctttcaagatggccactccctcgatgatgccgcagtggtcttacatgcacatcgccggtcaggacgcctcggagtacctgagtcccggtctggtgcaattcgcccgcgccacggacacctacttcaccctgggaaacaagtttaggaatcccactgtggctcccacccatgatgtcaccaccgaccgctcgcagcggttgacgctgcgttttgtgcccgtggatcgggaagatactgcttattcttacaaggctcgctttacgctggctgtgggggacaatcgcgtgcttgacatggctagctcttactttgatattagaggggtgctggatcgcggtcccagttttaagccttattcgggtaccgcctataactctttagctccaaagggcgcgcccaatgccagccaatggctaactacaaacaatggcaacaaaactcacacttttgctcaagcgccttacataggagactctatcagtaaagacggcattcaagttgggacaaacactgccaatccccagcaagcagtatatgccgacaaaacataccagccagaacctcaagtaggcgaaagtcaatggaacgcttcagtatctaacaatgcaaaagcagcaggaagggtgttaaaaagcactacgcccatgtatccgtgctatgggtcttatgcacgagcaacaaatgaaaaaggaggtcaatcaaaaaataacgacggtgtggaaatgcgattttttgcatccagtgcgaatgacaatcaaaatgatccaactgttgtaatgtatagcgaggacgtaaacttagaggctcctgacacacacattgtttacaaaccagctgtaactgcggacactatcagttcagaactcctcctaggacaacaagcagcacctaacagaccaaattacattgccttcagagacaattttattgggcttatgtattacaacagcactggaaacatgggagtacttgcaggacaggcttctcagctcaatgcagtggttgatctgcaagataggaacacagagctgtcctaccaacttatgttggatgctttaggcgatagaagccgttatttttccatgtggaattctgccgtcgacagctacgatccagacgtgcgaattattgaaaatcatggtgtggaagacgaactgcccaattactgttttccgttaggggctgtaggcgttgtgaattcatacaaaggtgtgaaacaaaatgacggaaatggttgggtaaaagatgacagtgtagcagataccaatgacatagccaaaggtaatatatttgccatggaaattaacttacaggcaaatttgtggagaagttttctgtattcaaatgtggggctgtacctgcctgacgacttgaaatacacccccgggaacataaaacttccagaaaacaaaaacacctacgagtacatgaacgggcgcgtgactgttcccggtctggtagacacctacgttaacattggcgcgcgctggtctcctgacgtaatggataacataaacccttttaaccaccaccgaaacgcagggttgcgctataggtccatgttactgggcaacggtagatttgttccgtttcacattcaggtacctcagaaatttttcgctattaagaatttgctgctgttaccagggtcctacacttacgagtggaacttcagaaaagatgtaaacatgatacttcagagcaccctgggcaatgatcttagagtggacggagccagcattcgctttgacaacattgccctgtatgcaaacttcttccccatggctcacaatacagcttctacattggaagccatgctgcgaaatgacaccaatgaccagtctttcaacgattacttgtgcgcggcgaacatgttgtatcccattccagcaaatgccaccagcgtgcccatttcaataccttcgcgaaattgggcagccttcagagggtggagttttactcgccttaaaactaaagagacaccttctcttggttcagggtttgacccctactttgtttactctggaaccattccctacctggacgggactttttacctgaaccacacttttaaaaaggtgtcaatcatgtttgactcctctgttagctggcctggaaatgacaggctgttaacaccaaatgaatttgaaataaaacgttctgtagacggggaaggctacaatgtggcccaatgtaatatgaccaaagattggtttctagtacaaatgctcagtcattataatattggataccagggtttttacgttccagagagctacaaagaccgcatgtattctttcttcagaaactttcagcccatgagcaggcaggttgtagacactactgaatacaaggagtataaaaaagtaaccgtggaattccagcataacaactcagggtttgtgggatacctgggtcctactatgcgcgagggacaagcttatcccgcaaactacccctatcctctcataggaaaaaccgctgtacagagcgtcacacaaaaaaagtttctctgtgaccgtgtgatgtggcgcattccattttctagcaattttatgtcaatgggggcgttgacagacctcgggcaaaatatgctgtatgcaaattcggcccatgcgttagatatgacatttgaagttgaccccatggaagagcccacccttctttatgttttgtttgaagttttcgacgtggtgcgcattcatcaaccacaccgcggagtcattgaagcggtctatctgcgcacacccttctccgcgggtaacgccaccacctaaagaaggcactttcccagatcgctgtaatgggttcaagcgaacaggagctgacggcgattgttcgagatctaggctgtggaccctattttttgggtacctttgacaaacgttttcccggttttgtgtctcgcgaccgcttatcatgcgctattgttaacactgccggtcgcgaaactgggggcgtacactggctggcctttgcatggaatcccaaatcgcacacttgctatttattcgatccatttggattctctgatcagcggttaaaacaaatctatcagtttgagtacgaaagtctgttgcgccgtagtgcgctagcggccactaacgaccgatgcgtcaccctagaaaagtcaacacaaactgtacaaggaccgttttctgcagcgtgcggcctgttttgttgtatgttcttacatgcttttactcactggcctgaccatccaatggataaaaatcccactatgaatctactaactggggttccaaatagtatgttacaaagtccgcaggtggaggacacactgcggaggaatcagcaagaactatatattttcttaaacaaattgtcaccttactttcgcaacaaccgccagcgcatagaaaaagccacctctttcactaaaatgaaaaattgatacaaatacacatgtacgtaatgcattaataaacaattttattagagaattgattacaagactgtttttttttttttattttattaaaaatcaaacggttcctctcgagaatcgccatggttggtgggcagggctatgtttctatactgcaaacgtggatgccacttgaactctggaataacaagcctaggaagcgggccttcaaaattttctccccatagctgtcgcacaagctgcaatgcacccatgacatcaggagctgatatcttgaagtcgcaattaggaccggcgttaccgcgggcattgcgataaactggatttgcgcactgaaaaaccagcaaacatggatacttaatactggccagggctccagggtcgctgacttcgttaacgtcgatgttttcaacattgctgaggttaaatggagtaattttacacagctgacgccccatgcgcggcaggccatcttgcttgtttaaacattcacaacgaactggcatcaggaaccgcttctgcccctgtcgcatgtgagggtagtcggccaacataaaagcctcaatttgcctaaaagccatttgagccttcgttccttctgaataaaacaaaccgcatgactttccggaaaaagaattattcccgcagccaacatcattaaaacagcagcgggcgtcatcatttttaatttgaactacattacgcccccagcggttttgcactaccttggctttagatggattttctttcagagctcgctgcccgctctcgctggttacatccatctctatcaagtgctctttgcgcaccatttccatgccgtgcaggcatctaagctccccttcgcgttcagtgcactggtgctcccatacacagcaaccagttggctcccaggcattttgttgaacaccggcataggcttgcatatatccttgtaggaagcgtcccataagctcctgaaaggttttctgggatgaaaaagttagctgcaacccgcgtttttcctcatttagccatgttgtacaaatttttttgtacaccgctccctgatctggcaaaaacctaaagctggcacgctcgtcgtgatccacatggtacttctccatcagcatagccattgcctccatgcctttttcccaagctgatatcagaggctcgctcgtggggttgcgaactattactacgcctttttgttctttgccttccatgttttgagcagcggcctttaaaatgcgcacctgcctttcttccattttttgaaaagactgagaaccgtctgcatgatgcataatgcgaacaggaggcatgctgaaacccatgactcctaagactgcatttggcggctcggtttcttcttctttttcgctctccggagatagagggatggtagccatggacctcctggcttttttctttggaggcaaaggcacagcctccaggtcttcttcgctttctgattccaaaaagtaccgacccatttttggaggtggcggctgagtgttgcggtctggggtgcgctccctctgtgagtgctgattgctggccattatttaatcctaggcaaagaaacacatcatggatccgcagtcaaaggaaaacttaaccgcccccaccgatactgctgttgctgccatggaaaagaacaaatgtctactcataccccaagatgcaccgcttgcgcaggactcgggctacgtgactccccccgaggaattggaaggctctcttctaatccaagagcaaccaaataaggaacaggcagaaagcaatgagcaagacgctgagctccatgactacctaggcaagggagatgtcttgcttaaacatttacagcgacaaagcattatcgttcgcgacgccgtagctgaccgctctttattgccagtctcaatcgcggaactttcttgcgcatacgaacgcaacctgttttctccccgtgtgccgcccaaacgacaagccaatggtacctgcgaaccaaatcctcggctgaacttttacccggtttttgcgataccagaagctctggcaacataccacattttttttaaaaatcatagaatacctctgtcttgccgagccaaccgcagtcgcgcagataagctccttacccttagcggtggtgcttccatacctggtatagtgtccttggaagaggtgcctcggattttcgaaggcttggatcgcgatgaaaagcgagcagcaaacgccctacaagcagaaaacaagcaaaatcaaagtgcgctcatagaactagaaggtgacaatgcccgtttggccattttaaaacgcaatgttgaagtaactcacttcgcatacccggcagtgaatcttccgccaaaggttatgagcgcagtaatgaatcaactactaattaagcgcgctcagcccattgacaaagatgcaaacttgcaagattcagaggcatcagatgatggaaaaccagttgtaagcgacgagcagctaattaagtggctgggaacagacaaccccgccaaactacagcagcggcgtaaacaaatgatggcggcagtacttgtaacggtggaactggagtgcatgcaccgttttttttccaacgttagcacgttgcgcaaaattgaagaatgtctccactacacctttcggcatggttatgtgcgccaagcctgcaaaatttccaatgtggagctaagcaaccttatctcatacatgggtattttgcacgaaaacagattgggacaaaatgtgctacattcaacgctacgcgacgaagcgcgcagagattacgtgcgggactgtgtttatctttttttgctacatacttggcaaaccggaatgggggtgtggcaacaatgcttggaagaaactaacctcagagaactcaacaaactgcttgacagagcgttgaaatcattatggacaggttttgacgagagaacggtagcggcagatttggcaaacattatttttccagaaaggctcatgataaccttgcaaaatggtctgcctgactttatgagtcaaagtatgctgcataattaccgttcttttatattggagcgatctggcttgttacctagcatgtgctgtgcgcttccttcagattttgtgcccattcattttagagaatgtccccctcctctgtggagtcactgctacttgttcaaacttgccaattacttagcttaccactcagaccttatgacggattccagcggagaaggattaatggagtgtcactgtcgctgcaatttatgcactcctcaccgttctctggtgtgtaataccgaactgcttagtgaaagccaggttattggtacgtttgaaatgcaaggaccgcactctgatagcaatctcaccacaaacctgaggctgacacctggcctttggacttccgcttacctgcgcaaatttgaacccctagattaccacgcacacgttattaatttttatgaagatcagttaaagccccctaaagcgccactaacggcctgcgtcattacgcagggaaaaattttagcccaattacaagccattaaacaagcgcgcgaagaattcttactcacaaaaggacgcggagtgtaccttgacccccagaccggcgaggaactgaaccttccatcacctctgtgtgctactgcatcctctccccattcgcagcatgtccccgaaaaccgcaaaacaagctattgcgcagcaacgctcaaagaagcagctacaacagcaggaaatctgggaggaagattcttgggacagtcaggcacaggaggaccaggacttggaagaatgggaggaggaaagcctagacgaggatccagaggaggacggttccaaggacggagcgaccgccgcaaaaccgtcgctttcaaccgaaccctctccagtgaaacacactgtcaacaaatctcagaaagcgagccgtagatgggacaccactgaagccagcgtcgtaaacatgggtaagaaatgcaagcaggtgcggcggggctactgctcatggcgggctcataaaagtaatatcatagcctgcttgcaacactgcgggggaaacatctcatttgcaaggcggtatctgctctttcacgatggagtggcaattcctaggaatgttctccattactaccgtcatctctacagccccttcgaagagatccacaaagaatcgacgtcttacggaccagcggcccactagaaaaaccggcagcagcaacaaggaaagtccagaggcgcgcgagttaagaaaacgcatttttcccactctatatgctatttttcagcagagccgaggccaagaacacgaactgaaaataaaaaacagatccctccgttcacttacccgcagctgtctctacctcaaaagcgaagaccagttgcaacgcaccttgcaggacgctgaagctctgttcaataaatactgctccctctcgcttaaagagtaaaaaaagcccgcgcgcggacttctgacaagcgggaaagtgacgtcacatttataacaggatgagtaaagatattcccacgccttacatgtggagttttcaacctcaaatggggctagcggcgggtgcggctcaagactattctactaaaatgaattggttaagcgccggcccacatatgatttcccaagtaaatggaattcgcgcccggcgaaaccaaatgctactacaacaagccgctctcaccgctacaccgcgtaaccagcttaacccaccctcttggccctctgccctattgtaccaggaaagtccccctccaacaacggtacttttgcctcgcgacgcccaggccgaagtccgcatgactaatgctggcgcacaactcgcgggcggcgcacgtcatagtttcaggtataaaggtcgccctgggccgtactcatcttctgctataaaaacaatacgcattagaggaaaaggtattcagctgaacgacgaggcaacatcgccactgggactcaggcccgacggagtgtttcagctggcaggctccggccgctcgtccttcactactcgtcaagcctacctaacacttcagagttcgtcaacagctccaagatccggcgggattggaactcttcaatttgtggaggaatttactccatctgtttactttaatcccttttcgggctcgcctggacactatcctgacgccttcatacccaactttgacgccgtgagcgaatctgtggatggttatgattaatgtctaatggagcggccgacagagcgcggctgcgacatttagaccactgtcgccaacctcgctgctttgctcgagacatctgcgagtttacttactttgagctgccagaggaacaccctcagggaccagctcacggcgtaaggataacagttgaaaaaggaattgatacacacctcattaaattttttaccaaacgcccgctattggttgaaaaggatcaagggaatactgtactaactctatattgcatttgtcctgcccccggattacatgaagatttttgctgtcatttgtgtgctgaatttaatcatttgtagtggcggtttaccgcctgaagaagaacctaactgtcatccgcctcttagtaacattaaaattaacctttcaatctctgacattactcttcgctgcaattttttctccacccatctcacctggagttttaacggaaaacccatcgccgaggtaaaattaaagtttcagctacacaaagaaaacatcactttatttgcacctattcacctgggatactaccgctgcgcagctccaccctgtcagcaagccttttttgtttctccgattattaacagaaaacctgctacaacaacacctgtcactcggcaaaacatccagacgacttctcctactaaaggtatagaggaaattgtgtacttttcaaactttacaaaccacttacttttaaactgttcctgctctaactccttaatctcatggtttgctaataacactttgtgtaaagctttttaccaacaaaaacttttgtattctgccaatttaacactgtgtaaccaaaccacttcttcccaccttactctactaccaccttttgtcgctggtcgttatttttgcttaggagctgccggtactagcccctgtcaacagcactggagattaacttatcgcccaacgccagtaacgccttctgtaataacagaggcatttacctctaataccttgcttctatatagtggtcttgtggctcttactctatttctaatttctaacttgtttctagtgcagcatttgtatttgtactaatcatgcttagtattttagtctttgtttttttacctttcctcctacatgctcaaacatctgagaaaccattgaaagtatttgtggaagttggccataatgtaaccctcccccatctcatgcctgattcacacgaaacaggccatgtgacttggctagtagaaacagcagattacggtgtagcttctccaaacaactttatttttagtggacaaaaactatgccagtttacttccagaactatggtgtggccttatgccaatctagattttaactgcgctaattatgacctccatttgtttcggcttaaggtagaaaattcagccatttacaatgttaaaaataccatcaatgcatctgaaatgaatatctactatcaattaacagtaattgacattcttccacccaaatgcatcattacttcaaagtacctcacaaataattattgtcacattaccattaactgcaccaactcggtgtatccaaacaaagttcagtttaataatgtcactcgattctactatggatacgccaagggaggcccaaacctacctaattatttcaccactaattttaatgtatcaggtattactaaaagctttaaccacagttacccttttaatgagctgtgtgatgaccccgtgttccaacctcagaataatttaaaaaacacggtgattttcttagtaataattgcatttagcgttctcattattattgcagccctcacttacctgtgctgtcacaaacagacttaaatcttatagcttttttttttttccttacagtatggtgacggttcttcttatattcttatgcctgccaatcattttttcttcttcaacttttgcagcagtgagtcacattgatcctgattgtatagcaccctttgcggtgtatttgatttttacatttgtgaccgccacgtgcgtctgcagtcttataactttacttcttacctcgcttcaattttttgattactactacgtgcgatacgtttaccgcagacatcaccctcgttatcaaaacccccacattgcagctcttctccatctacaaccatgaaagcagcgttagccatcttcatgttaactccaatgttggccacttcttgtaagcttcacgtgccatggactttcttagactgctacaccaaagagacagattacataggctgggtgtatgggattatgtctgccttagtttttgtatcctctgtagtttccttaaaactttatacgcttattaattttagttggaatcaatacactgatgatctccctgagtacccacaccaccaggatgatttacccctaaacattgtacttccacagcccccacgtcctccttcggttgttagctattttaagttcgccggtgaagatgattgaacccgacctacaaatggatggaacaatgaccgaacagaggttgcttgctgatcgcgctaggcgtcgccaacaggatcaaaaaaataaagagttacttgatttacaaaccgttcatcagtgtaaaaaaggacttttttgcctggtaaaacaagccaccctccgctacgagaatttaccaggcaaagagcatcaactttgctacacgctgcctactcagcgacaaagcttcaccgcagtcgtgggttcggtgcctattaaagtgtcccaacaagcaggacagcaagaaggctccatttgctgcctatgtaccagccctgaatgtttgtacactttaataaaaacactgtgcggcataagaaagcttttaccaatgaattaaataaatcacttacctgaaatttaaaaatacattgtggtctccatgtactcttacaaaatttccttcttcccaactatcaaagccaatagacttgcaaacagcaaattttctccaaattttaaatggaatgtcagaattttcttcccaattcctacccaccatcttcatcttttttagatgaagcgcagcagaacccagtacgctgaagaacctgaagaaaatgacgacttcaaccccgtttacccttttgacccatatgacacagcgcatgtgccctttgttacacccccttttacttcttccaatgcttttcaagaaaaaccacccggtgtattatcacttaattacaaagatcccattgttactgaaaatggatcccttaccctaaagttagggaacggaataaagcttaattcacaaggtcaacttacaaccactaacactaaagtactagaaccccttgcccacacctcacagggtcttacactttcttggagcgccccattatcagttaaggccagtgcccttacacttaatacaatggcaccattcacaacaacaaacgaaagcttaagcttggtcactgcccctcccattacagtggaagcttcacaattgggcttagccactgtagcacctctaagcttagacggagggggaaaccttggtttggatcttctcgctcccttagttgtaaattctagcaacgcgctaaccctatctgcttcagatccgttaactgtaaattccaatagtttaggattaaatattaccagtcccattacactaataaacggatccttggctttagccacatcccctcctctggacaccacaggatctactttaaatctttctgttgctgctcctctcagtgtttcacagaacgcactcactgtttcaaccggtaacggtcttcaagtatcaggatctcaattagtaacaagaataggagatggtttacgatttgataatggggttataaaagcatatgttgccgggggaatgagactctcagggggtaaaataattttagatgttaattatccctttgatgcaaccaccaacctttcattgaggagaggatcgggcctcatatataatgagtctacaaactggaacttaacaactgatatcagcaccgaaaaaggcctaacgtttagtgggaaccaaatagctatcaacgcaggtccaggtctcacgtttaataaccgcaagcttcaggtaaaattgggcgcgggactcactttcgattcaaatgataatattgccttaaatagtattgctactccgtatgatcctttaacgttgtggacaactccggatcctccgcccaactgcactctcagacaagaacttgatgcaaaactaactttgtgtttaacaaagaacgaatctattgtgaatggcatagttagtttgataggtgttaagggggatctcttacatattcaacctaccaccaccactgtgggactgcatttagtgtttgatcgacagggacgattagtcacaacaacgcccactgccttagttccccaggcttcctggggatataaacaaggtcaatcggtatctagcagcgctgttgctaatgctttaggattcatgcctaatgtaagtgcttaccctagaccaaacgcgggtgaagccaaaagtcaaatgttaagtcagacatatttacagggagatacaactaaacctattacaatgaaagttgtatttaatggcaatgcaacagtggatggatactctctaacatttatctggacaggtgtgtcaaactatctaaaccaacagttttcaacaccatcttgttcattttcgtatattgcccaagaataaaaaaaacacaaatttgcataccgtgatcatttattaattcttttttacaatacgagtagttatactgccttcttcccatttcaccttgtatacctccctctcccactttgttgcggaaaacagctgcgcttgaatgtttctactttggttttttggtgttaacgtccacacggtttccttctgggcaaaacgacagtcggtgatacaaacaaatccttcgcccgcacagtctcttaaactgcattccattttatcctacaaaaggtaacaacagtcagtgtccatcagccgcccatgggttttctcgatgattgtaatctccaaataaaattgcttgatgatgcataataagaccctttagcagtcgctgacgatggccttcgcaccaactatgttttagtgggcgaacagtgttctcagcaattactttaacaacttttaacattaatagtctggtacgacgagcgcaacagcgcatgcgtatttcacttaagtctttgcaatagtcacagcacaacactaacatgttatttaaaattccataattaaaggtactccatccaaaactaatcttttctagcgctaaccaagcatggccatcatacataattttaacataaatcaaatggcgacctctaacaaaggtgcttcccacatacattatttcttttggcataaaatggttaacaacctcccgataccaaaaacatcttttgttaattaatgttccatatacagccattttgaaccagcgtcctaaaagcatcccagctgacatacactgtaatgaacccggacgctggcaatgacaatgtattagccaccgctcataaccatgtaacaattgagtaatttcaacatctatggtggcacaacacaaacacacactcatgtatttttttaaaataaacatctcataattagttaaaatcatatcccatggtattggccattcttgcaatacagtaaaccctacacatgaaggaatacctcttacctcacttacattatgcaaagtcagactattacactcaggccatgcagaattctctgacagagtagcttttgactgctgttcacaaggtggtagatggtacttgctgtacggcgccagtctgcaaccataccgtctgtcgcgctgcatcgtaaaccacagacttgcgagcgtcttcgtacttcgaataacaaaaccacgtacgcccactggttacagcgccgcgtcccttttgctttcgacgttggcgttccgtcacaaacgcaaaatataaccactctcgcaggcttaatagaatgtactcagcttcaggtgtgattttcaaattatgctctttaacaaagcgaatagtatccacacaggtcgcatgggccaaaccaagccatccaatacaggcagctgtatcccgacatatgggaggttgaggaatacaaggcaaaggcataaaagctaatcaagacggtcagcaagtatttgaatgcgtaaatctcgcaggtggcagcgatcacctccgctgtgctggtgaaaaatcacagccagatcaaattgtaagcggttttccaaatgttcaacaacagcatctaaaagagccacggctctaatttccacaaacaaaagtaaagcaaatgcgttatcatgaaactcttctatcatcagactgcctgactgaaccattcccaaataattttcattcttccactgttgtattatttgaacacactgattttgcaggtttaagccatgaatattaaaaagctctgtaagggcgccctccaccgccatccgcaggcagtacttcatatttgctgaaaaaagtctggatcttcaaacacctgcagtaaattcagtagatttacattaggctccacaccttgctctcgcagctgacatcttaaagccagttgtataaaatcatgcaaatcagaagccagcagcaaagaaagttcacctccaggtacaagttccggagtccccacagagcatacaacttgcacaaatgggcccatattagtaagcgtggcgccaacgtagacatcgcgcataggaggagttaaataatgcattaccaacagccaaaactcaggtagcacgtctttaagaaacgccaccacctcaaaatttaagccatgcaaatagttcaataaagactccggaaacatcacggagtaatgaacaagcggcctctgaaacatgctttaggttagcctgaaaaataaaaatatgttaaagtaaagttgcctggcgaataggtggaaaaataactctatttaaaaccaagcgcgcaactggctgctttgcgcggacatcgcaaaacacatccgagtgattaaacaacaaaacactaagctccattcttgagcctggataaagcgtttcagcgccaacaaaaacccctctggcgttcatgccgctcaaggaaaacaaagttcccacatatccaggaggaagatcaactgctatgtttaaatatagaagcacaactccgtgtggaggtataacaaaattcgcaggagaaaataacacataagcattagaatagccttcttgttcaggtaacatagccccgggtcccttaaaatacacatatacagcctcgaaaacagccataataccttaccgaaaaaacagtacaaagccaggcacagcagacacaatctgccgcaagtgcacacttttaatactgaaaaacagtgacgtagatgaccaaagttcacctgcgcaacaaaaaaccccgaaacacccgcgaaattcacttccgtaaatgactcggcacaatataatattcccacggttcgtcacatccggcgcgcccggctcccacacgcgtcacatccggcttcggcaaacttgcaaaccacgcctacggtcaattaactattcactccgcccacttcattttaatattggctcaagtccagtgtaaggtatattattgatgatgggccagtgaattgtaatacgactcactatagggcgaattgggccctctagatgcatgctcgagcggccgccagtgtgatggatatctgcagaattcgcccttccttaattaacctgcag

SEQ ID NO: 4 - DNA, 35360 bp, Adenovirus B3
  MISC_FEATURE (1)..(35360): Complete Genome
tttaaacctatctatataatataccttatagatggaatggtgccaacatgtaaatgaggtaatttaaaaaagtgcgcgctgtgtggtgattggctgcggggttaacggctaaaaggggcggcgcgaccgtgggaaaatgacgtgacttatgtgggaggagttatgttgcaagttattacggtaaatgtgacgtaaaacgaggtgtggtttgaacacggaagtagacagttttcccacgcttactgacaggatatgaggtagttttgggcggatgcaagtgaaaattctccattttcgcgcgaaaactaaatgaggaagtgaatttctgagtcatttcgcggttatgccagggtggagtatttgccgagggccgagtagactttgaccgtttacgtggaggtttcgattaccgtgtttttcacctaaatttccgcgtacggtgtcaaagttctgtgtttttacgtaggtgtcagctgatcgctagggtatttaaacctgacgagttccgtcaagaggccactcttgagtgccagcgagaagagttttctcctccgcgccgcaagtcagttctgcgctttgaaaatgagacacctgcgcttcctgccacaggaggttatctccagtgagaccgggatcgaaatactggagtttgtggtaaataccctaatgggagacgacccggaaccgccagtgcagcctttcgatccacctacgctgcacgatctgtatgatttagagatagacgggccggaggatcccaatgaggaagctgtgaatgggttttttactgattctatgctgctagctgctgatgaaggattggacataaaccctcctcctgagacacttgttaccccaggggtggttgtggaaagcggcataggtgggaaaaaattgcctgatctgggagcagctgaaatggacttgcgttgttatgaagagggttttcctcccagtgatgatgaagatggggaaactgagcagtccatccataccgcagtaaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctatttaataactgttgaatggtagatttatgtttttttcttgcgattttttgtaggtcctgtgtctgatgatgagtcaccttctcctgattcaactacctcacctcctgaaattcaggcgcccgcacctgcaaacgtatgcaagcccattcctgtgaagcctaagcctgggaaacgccctgctgtggataagcttgaggacttgttggagggtggggatggacctttggaccttagtacccggaaactgccaaggcaatgagtgccctgcagctgtgtttatttaatgtgacgtcatgtaataaaattatgtcagctgctgagtgttttattacttcttgggtggggacttggatatataagtaggagcagatctgtgtggttagctcacagcaacctgctgccatccatggaggtttgggctatcttggaagacctcagacagactaagctactgctagaaaacgcctcggacggagtctctggcctttggagattctggttcggtggtgatctagctaggctagtgtttaggataaaacaggactacagggaagaatttgaaaagttattggacgatagtccgggactttttgaagctcttaacttgggtcatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctgggagtagcagggatactgagacacccaccgaccatgccagcggttctgcaggaggagcagcaggaggacaatccgagagccggcctggaccctccggtggaggagtagctgacctgtttcctgaactgcgacgggtgcttactaggtctacgaccagtggacagaacaggggaattaagagggagaggaatcctagtgggaataattcaagaaccgagttggctttaagtttaatgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagtttttagatgttgtatgatgggtatgtggccaggggttgtcggcatggaagcagtaacacttatgaatattaggtttaaaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcggatgagaggccttatcagatgctgacctgcgctggtggacattgcaatattcttgctaccgtgcatatcgtttcacatgcacgcaaaaaatggcctgtatttgaacataatgtgattaccaagtgcaccatgcacataggtggtcgcaggggaatgtttatgccttaccagtgtaacatgaatcatgtgaaggtaatgttggaaccagatgccttttccagagtgagcttaacaggaatctttgatatgaatattcaactatggaagatcctgagatatgatgacactaaaccaagggtgcgcgcatgcgaatgcggaggcaagcatgctagattccagccggtgtgcgtggatgtgactgaagacttgagacccgatcatttggtgcttgcctgcactggagcggagttcggttctagtggtgaagaaactgactaaagtgagtagtggggcaagatgtggatggggactttcaggttggtaaggtgggcagattgggtaaattttgttaatttctgtcttgcagctgccatgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattatggaagcatcgttgccaattccagttcctctaataacccttcaaccctggctgaggacaagctacttgttctcttggcgcagctcgaggccttaacccaacgcttaggcgaactgtctaagcaggtggcccagttgcgtgagcaaactgagtctgctgttgccacagcaaagtctaaataaagatctcaaatcaataaataaagaaatacttgatataaaacaaatgaatgtttatttgatttttcgcgcgcggtatgccctggaccatcggtctcgatcattgagaacgcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatccggggtgaaattatatgcattttggactggatcttgaggttggcaatgttgccgcctagatcccgtctcgggttcatattgtgcaggaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctctggcccgggagcatagtttccctcacatatttgcatttcccaggctttcagttcagagggggggatcatgtccacctgcggggctataaaaaataccgtttctggagccggggtgattaactgggacgagagcaaattcctaagcagctgagacttgccgcacccagtgggaccgtaaatgaccccaattacgggttgcagatggtagtttagggaacgacagctgccgtcctcccggagcaggggggccacttcgttcatcatttcccttacatggatattttcccgcaccaagtccgttaggaggcgctctcccccaagggatagaagctcctggagcgaggagaagtttttcagcggcttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgggcgtccagcgctgccagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgattggcgccctgcatgtcggccaggtagcagtttaccatgagttcgtagttgagcgcctcggccgcgtggcctttggcacggagcttacctttggaagttttatggcaggcggggcagtagatacatttgagggcatacaacttgggcgcgaggaaaatggattcgggggagtatgcatccgcaccgcaggaggcgcagacggtttcgcactccacgagccaggtcagatccggctcatcggggtcaaaaacaagttttccgccatgttttttgatgcgtttcttacctttggtttccatgagttcgtgtccccgctgggtgacaaagaggctgtccgtgtccccgtagaccgactttatgggcctgtcctcgagcggagtgcctcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttccggatcgctgtccaggagcgccagctgttggggtaggtattccctctcgaaggcgggcatgacctctgcactcaggttgtcagtttctaggaacgaggaggatttgatattgacagtaccagcagagatgcctttcataagactctcgtccatctggtcagaaaacacaatcttcttgttgtccagcttggtggcaaatgatccatagagggcattggatagaagcttggcgatggagcgcatggtttggttcttttccttgtccgcgcgctccttggcggtgatgttaagctggacgtactcgcgcgccacacatttccattcaggaaagatggttgtcagttcatccggaactattctgattcgccatcccctattgtgcagggttatcagatccacactggtggccacctcgcctcggaggggctcattggtccagcagagtcgacctccttttcttgaacagaaaggggggagggggtctagcatgaactcatcaggggggtccgcatctatggtaaatattcccggtagcaaatctttgtcaaaatagctgatggtggcgggatcatccaaggtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacatcgcccccctctgatgcttgctcgcacatagtcatagagttcatgtgagggggcaagaagacccgggcccagattggtgcggttgggtttttccgccctgtaaacgatctggcgaaagatggcatgggaattggaagagatagtaggtctctggaatatgttaaaatgggcatgaggtaagcctacagagtcccttatgaagtgggcatatgactcttgcagcttggctaccagctcggcggtgatgagtacatccagggcacagtagtcgagagtttcctggatgatgtcataacgcggttggcttttcttttcccacagctcgcggttgagaaggtattcttcgtgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttgaggaattgatacttgaagtcgatgtcatcacaggccccctgttcccagagttggaagtccacccgcttcttgtaggcggggttgggcaaagcgaaagtaacatcattgaagaggatcttgccggccctgggcatgaaatttcgggtgattttgaaaggctgaggaacctctgctcggttattgataacctgagcggccaagacgatctcatcaaagccattgatgttgtgccccactatgtacagttctaagaatcgaggggtgcccctgacatgaggcagcttcttgagttcttcaaaagtgagatctgtagggtcagtgagagcatagtgttcgagggcccattcgtgcacgtgagggttcgctttaaggaaggaggaccagaggtccactgccagtgctgtttgtaactggtcccggtactgacgaaaatgctgtccgactgccatcttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcagcgattcacgggatgcaccttatgaatgagttgtacctgacttcctttgacgagaaatttcagtggaaaattgaggcctggcgcttgtacctcgcgctttactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattaacttgcatgatcttttggagggcgtgagggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacagcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttaaaaaactgggagttacgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctcttgggagggtgagacgatgctgctggtgatgaaattaaaataggcagttttgagacggcggatggtggcgaggagcaccaggtctttgggtccggcttgttggatacgcaggcgatgagccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttcggcgaggatggcttgctgcacctgggtgagggtggcttggaagtcgtcaaagtccacgaagcggtggtaggccccggtgttgattgtgtaggagcagttggccatgactgaccagttgactgtctggtgcccagggcgcacgagctcggtgtacttgaggcgcgagtatgcgcgggtgtcaaagatgtaatcgttgcaggtgcgcaccaggtactggtagccaatgagaaagtgtggcggtggctggcggtacaggggccatcgctctgtagccggggctccgggggcgaggtcttccagcatgaggcggtggtagccgtagatgtacctggacatccaggtgataccggaggcggtggtggatgcacgtgggaactcgcgcacgcggttccagatgttgcgcagcggcatgaagtagttcatggtaggcacggtctggccagtgaggcgcgcgcagtcattgacgctctgtagacacggagaaaacgaaagcgatgagcggctcgactccgtggtctgggggaacgtgaacgggttgggtcgcggtgtaccccggttcgagtccaaagctaagcgatcacgctcggatcggccggagccgcggctaacgtggtattggctatcccgtctcgacccagccgacgaatatccagggtacggagtagagtcgtttttgctgctttttcctggacgtgtgccattgccacgtcaagctttagaacgctcagttctcgggccgtgagtggctcgcgcccgtagtctggagaatcagtcgccagggttgcgttgcggtatgccccggttggagcctaagcgcggctcgtatcggccggtttccgcgacaagcgagggtttggcagccccgttatttccaagaccccgccagccgacttctccagtttacgggagcgagccctttttttttttttttttttgtttttgtcgcccagatgcatccagtgctgcgacagatgcgcccccagcaacaggccccttctcagcaacagccacaaaaggctcttcttgctcctgcaactactgcagctgcagccgtgagcggcgcgggacagcccgcctatgatctggacttggaagagggcgagggattggcgcgcctgggggctccatcgcccgagcggcacccgcgggtgcaactaaaaaaggactctcgcgaggcgtacgtgccccagcagaacctgttcagggacaggagcggcgaggagccagaggagatgcgagcatctcgatttaacgcgggtcgcgagctgcgccacggtctggatcgaagacgggtgctgcaagacgaggattttgaggtcgatgaagtcacagggatcagcccagctagggcacatgtggccgcggccaacctagtctcggcctacgagcagaccgtgaaggaggagcgcaacttccaaaaatcttttaacaaccatgtgcgcaccctgatcgcccgcgaggaagtgaccctgggtctgatgcatctgtgggacctgatggaggctatcgcccaaaaccccactagcaaaccactgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtgaagatagatgggttttacatgcgcatgactctgaaggtgctgactctgagcgacgatctgggggtgtatcgcaatgacaggatgcaccgcgcggtgagcgccagcaggaggcgcgagctgagcgacagagaacttatgcacagcttgcaaagagctctaacgggggccgggactgatggggagaactactttgacatgggagcggatttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttctgccatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcaaaccaacctggaccggatggtgaccgatgtgcgcgaggccgtgtctcagcgcgagcgattccagcgcgacgccaacttggggtcgttggtagcgctaaacgctttcctcagcacccagcccgccaacgtgccccgtggtcagcaagactatacaaactttttgagtgcattgagactcatggtagctgaggtgccccagagcgaggtgtaccagtccgggccagattacttcttccagaccagcagacagggcttgcagacagtgaacctgactcaggctttcaagaacctgaagggtctgtggggagtgcacgccccagtaggggatcgcgcgaccgtgtctagcttgctgactcccaactcccgcctgctgctgctgctggtatccccctttactgacagcggtagcattgaccgcaactcgtacttgggctacctgcttaacctgtatcgcgaggccataggacagagccaggtggacgagcagacctatcaagaaatcacccaagtgagccgcgccctgggtcaggaagacacgggcagtttggaagccaccctgaacttcttgctaaccaaccggtcacagaagatccctcctcagtatgcgcttaccgctgaggaggagcggatcctcagatacgtgcaacagagcgttggactgttcctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtggacagcagcatattttccccgcctcccggttatacagtttggaagaaggaagggggcgatagaagacactcttccgtgtcgctatccggaacggctggtgctgccgcgaccgtgcccgaagctgcaagtcctttccctagcttgcccttttcactaaacagcgttcgcagcagtgaactggggagaataacccgcccgcgcttgatgggcgaggatgagtacttgaatgactctttgctgaggccagagagggaaaagaacttccccaacaatggaatagagagtctggtggataagatgagtagatggaagacctatgcgcaggatcacagagacgagcccaggatcttgggggctacaagcagaccgatccgtagacgccagcgccacgacaggcagatgggtcttgtgtgggacgatgaggactctgccgatgatagcagcgtgttggacttgggtggaagaggagggggcaacccgttcgctcatctgcgtcccagattcgggcgcatgttgtaaaagtgaaagtaaaataaaaaggcaactcaccaaggccatggcgaccgagcgtgcgttcgttcttttttgttatctgtgtctagtacgatgaggagacgagccgtgctaggcggagcggtggtgtatccggagggtcctcctccttcttacgagagcgtgatgcagcaacaggcggcgatgatacagcccccactggaggctcccttcgtacccccacggtacctggcgcctacggaagggagaaacagcattcgttactcggagctgtcgcccctgtacgataccaccaagttgtatctggtggacaacaagtcggcggacatcgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaagctcctgaaggtgttacagtaaatgacacctatgatcataaagaggatatcttgaagtatgagtggtttgagttcattttaccagaaggcaacttttcagccaccatgacgatcgacctgatgaacaatgccatcattgacaactacctggaaattggcagacagaatggagtgctggaaagtgacattggtgttaagtttgacactagaaatttcaggctcgggtgggaccccgaaactaagttgattatgccaggtgtctacacttatgaggcattccatcctgacattgtattgctgcctggttgcggggtagactttactgaaagccgacttagcaacttgcttggcatcaggaagagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgatgatataactagaggagatacctatataactgaaaaacaaaaacgtgaagctgcagctgctgaagttaaaaaagagttaaagatccaacctctagaaaaagacagcaagagtagaagctacaatgtcttggaagacaaaatcaacacagcctaccgcagttggtacctgtcctacaattacggtaaccctgagaaaggaataaggtcttggacactgctcaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttctaaaaaaaaaaaaaatgtccattctcatctcgcccagtaataataccggttggggactgtatgcgcccaccaagatgtatggaggcgcccgcaagcgctctacccagcatcctgtgcgcgttcgcggtcatttccgcgctccctggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcatcgccaggcgccacagggctactcccgccatgcgagccgcaaaagctattctgcggagggccaaacgtgtggggcgaagagccatgcttagagcggccagacgcgcggcttcaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccgccggtgaaggatgaaaaaaagccccgcaaaatcaagcgggtcaaaaataacaaaaaggaagaagatgacgatgatgggctggtggagtttgtgcgcgagttcgccccaagacggcgcgtgcagtggcgcgggcgcaaagtgcgtcaagtgctcagacccgggaccactgtggtttttacacctggcgagcgttccagcactacttttaaacggtcctatgatgaggtgtacggggatgacgatattcttgagcaggcggcagaccgccttgacgagtttgcttatggcaagcgcactagatccagtcccaaagaggaggctgtgtccattcctttggatcatggaaatcccacccccagcctcaaaccagtcaccctgcagcaagtgctgcccgtgcctgcgcggagaggcgtaaagcgcgagggtgaggacctatatcccaccatgcagctaatggtgcccaagcgccagaggctagaagacgtactggagaaaatgaaagtggatgccgatatccagcctgaggtcaaagtaagacctatcaaggaagtggcgccaggtttgggagtacaaaccttcgacatcaagattcccaccgagtccatggaagtgcagaccgaacctgcaaaacccaccacctcaattgaggtgcaaacggaaccctggatgcccgcgcccgttgccgcccccagcaccactcgaagatcacgacgaaagtacggcccagcaagtctgctaatgcccaactatgctctgcacccatccatcattcccactccgggttacagaggcactcgctactatcgaaaccggagcaacacctctcgccgccgcaaaccacctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcagacgattagggggtggctttttgccagctcttatacccatcatcgccgcagcgatcggggcgataccaggcatagcttcagtggcggttcaggcctcgcagcgccactaacattggaaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatctggccaaccaggctgtacaaaaacagataaacagccgcctggacccgccgcccgcaacccctggtgaaatggaagtggaggaagaacttcctccgctggaaaagcggggcgacaagcgtccgcgacccgagctagagcagacgctggtgacgcgcgcagacgagcccccttcatatgaggaggcagtaaagctcggaatgcccactaccaggcctgtagctcacatggctaccggggtgatgaaaccttctcagtcacatcgacccgccaccttggacttgcctcctccccctgcttctgcggcgcctgttcccaaacctgtcgctaccagaaagcccaccgccgtacagcccgtcgccgtagccagaccgcgtcctgggggcacaccgcgcccgaaagcaaactggcaaagtactctgaacagcatcgtgggtctgggcgtgcagagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctcagtccgggtctggtgcagttcgcccgtgcaacagacacctacttcagtatggggaacaaatttagaaaccccacagtggcgcccacccacgatgtgaccaccgaccgtagccagcgcctgatgctgcgcttcgtgcccgttgaccgggaagacaatacctactcttacaaagttcgctacacgctggctgtaggcgacaacagagtgcttgacatggccagcacattctttgacattcggggggtgcttgatagaggtcctagcttcaagccatattccggcacagcttacaattcactcgctcctaagggcgcgcccaatacatctcagtggatagttacaacaaatggggacaatgcagtaactaccaccacaaacacatttggcattgcttccatgaagggagacaatattactaaagaaggtttgcaaattgggaaagacattaccactactgaaggagaagaaaagcccatttatgccgataaaacatatcagccagagcctcaagttggagaagaatcatggactgatactgatggaacaaatgaaaagtttggtggaagagcccttaaaccagctaccaacatgaagccatgctacgggtcttttgcaagacctacaaacataaaagggggccaagctaaaaacagaaaagtaaaaccaacaaccgaaggaggggttgaaactgaggaaccagatattgatatggaatttttcgatggtagagatgctgttgcaggagctttagcgcctgaaattgtgctttatacggaaaatgtaaatttggaaactccagacagtcatgtggtatataaaccagaaacgtctaataactctcatgcaaatttgggtcaacaagccatgcctaacagacccaattacattggcttcagggataacttcgtaggcctaatgtactacaacagtactggaaatatgggagttttggctggccaagcatcacaactgaatgcagtggttgacttgcaggacagaaatactgaactgtcatatcagcttttgcttgattctctgggagacagaaccagatacttcagcatgtggaatcaggctgtggacagttacgatcccgatgttcgcattattgaaaatcatggcatcgaggatgaactgcctaattactgttttcctctgaatggcataggaccagggcacacatatcaaggcattaaagttaaaaccgatgacactaatggatgggaaaaagatgctaatgttgctccagctaatgaaataaccataggcaacaacctggctatggaaattaatatccaagctaacctttggagaagttttctgtactctaatgtggctttgtaccttccagatgtttacaagtacacgccacctaacattactttgcccactaacaccaacacctatgagtacatgaacgggcgagtggtatccccatccctggttgattcatacatcaacattggcgccaggtggtctcttgacccaatggacaatgtgaatccattcaaccaccaccgcaatgctggtctgcgctacaggtccatgcttctgggaaatggtcgttatgtgcctttccacatacaagtgcctcagaaattctttgctgtcaagaacctacttcttctacctggctcctacacctacgagtggaacttccgaaaggatgtgaacatggtcctgcaaagttcccttggaaatgacctcagaacggatggtgctaccataagtttcaccagcatcaatctctatgccaccttcttccccatggctcacaacacagcttccacccttgaagccatgctgcgcaacgataccaatgatcagtcatttaacgactacctctctgcagctaacatgctttaccccattcctgccaatgcaaccaacattccaatttccatcccatctcgcaactgggcagccttcaggggctggtccttcaccagactcaaaaccaaggagactccatctcttggatcagggttcgatccctacttcgtatattctggatctattccctacctggatggcaccttttaccttaaccacactttcaagaaggtctccatcatgtttgactcctcagtcagctggcctggcaatgacaggctgttgagtccaaatgagtttgaaatcaagcgcactgtggacggggaaggatacaacgtggcacaatgcaacatgaccaaagactggttcctggttcagatgcttgccaattacaacattggctaccagggcttttacatccctgagggatacaaggatcgcatgtactcctttttcagaaacttccagcctatgagcaggcaggtggttgatgaggttaattacactgactacaaagccgtcaccttaccataccaacacaacaactctggctttgtagggtaccttgcacctactatgagacaaggggaaccttacccagccaattatccatacccgctcatcggaactactgccgttaagagtgtcacccagaaaaagttcctgtgcgacaggaccatgtggcgcattcccttctccagcaacttcatgtccatgggggcccttaccgacctgggacagaacatgctctatgccaactcagcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgacatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctacaacacctgctacctttttgatccttttgggttctcggatgagcggctcaaacagatttaccagtttgagtacgaggggctcctgcgtcgcagtgcccttgctaccaaagaccgctgcatcaccctggagaagtctacccaaagcgtgcagggtccgcgctcagccgcctgtggacttttttgctgtatgttccttcatgcctttgtgcactggcccgaccgccccatggacggaaaccccaccatgaagttgctgactggggtgtccaacagcatgctccaatcaccccaagtccagcccaccctgcgccgcaaccaggaggtgctataccgcttcctaaacacccactcatcttactttcgttctcaccgcgcgcgcattgaaagggccaccgcgtttgaccgtatggatatgcaataagtcatgtaaaaccgtgttcaataaacagcactttatttttacatgcactgaggctctggttttgctcatttgtttcatcatttactcagaagtcgaatgggttctggcgggagtcagagtgacccgcgggcagggatacgttgcggaactgtaacctgttctgccacttgaactcggggattaccagcttgggaactggaatctcgggaaaggtgtcttgccacaactttctggtcagttgcatagcgccaagcaggtcaggagcagagatcttgaaatcacagttggggccggcattctggacacgggagttgcgatacactgggttgcaacactggaacactatcaacgctgggtgtcttacgcttgccaacacggttgggtcactgatggtagtcacatccaagtcttcagcattggccatcccaaagggggtcatcttacatgtctgcctgcccatcacgggagcgcagcctggcttgtggttgcaatcacaatgaatggggatcagcatcatcctggcttggtcgggagttatccctgggtacacagccttcatgaaggcttcgtactgcttaaaagcttcctgggccttacttccctcggtgtagaacatcccacaggacttgctggaaaattgattagtagtacagttggcatcattcacacaacagcgggcatcgttgttggccaactgaaccacatttctgccccagcggttttgggtgatcttggctctgtctggattctccttcatagcgcgctgcccgttctcgctcgccacatccatctcgataatgtggtccttctggatcatgatagtgccatgcaggcatttcaccttgccttcataatcggtgcatccatgagcccacagagcgcacccggtgcactcccaattattgtgggcgatctcagaataataatgtaccaatccctgcatgaatcttcccatcattgttgtcaaggtcttcatgctggtaaatgtcagcgggatgccacggtgctcctcgttcacatactggtggcagatacgcttgtattgctcgtgctgctctggcatcagcttgaaagaggttctcagatcattatccagcctgtacctttccattagcacagccatcacttccatgcccttctcccaggcagataccaggggcagactcaaaggattcctaacagcaataaaagtagctcctttagctatagggtcattcttgtcgatcttctcaacacttctcttgccatccttctcaatgatgcgcaccggggggtagctgaagcccacggccaccaactgagcctgttctctttcttcttcactatcctggctgatgtcttgcagagggacatgcttggtcttcctgggcttcttcttgggagggatcgggggaggactgttgctccgctccggagacagggatgactgcgaagtttcgcttaccaataccacctggctctcggtagaagaaccggaccccacacgacggtaggtgttcctcttcgggggcagaggtggaggcgactgagatgggctgcggtctggccttggaggcggatggctggcagagctcattccgcgttcgggggtgtgctcccggtggcggtcgcttgactgatttcctccgcggctggccattgtgttctcctaggcagagaaacaacagacatggaaactcagccatcactgccaacatcgctgcaagcaccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaaacggaagagattgaggcagatgtcgagcaggacccgggctatgtgacgccggcggagcaccaggaggagctgaaacgctttctagacagagaggatgacgaccgcccagagcatcaagcagatggcgtttaccaggaggctgggatcagggatcatgtcgccgactacctcaccggccttggtggggaggacgtgctcctcaaacatctagcaaggcagtcgatcatagttaaagacgcattgctcgatctcactgaagtgcccatcagtgtggaagagcttagccgcgcctacgagctgaacctcttttcgcctcaggtaccccccaagcggcagccaaacggcacctgcgaggccaaccctcgactcaacttctatccagcttttactatccccgaagtgttggccacctaccacatctttttcaagaaccaaaagattccagtctcctgccgcgccaaccgcacccgcgccgatgccctgctcaacttgggtccgggagctcgcttacctgatatagcttccttggaagaggttccaaagatctttgagggtctgggaagtgatgagacacgggccgcaaatgctctgcaacagggagagaatgacatggatgaacaccacagcgctctggtggaactggagggtgacaatgcccggattgcagtgctcaagcgcagtatcgtggtcacccattttgcctaccccgctgttaacctgccccccaaagttatgagcgctgtcatggaccatctgctcatcaaacgagcaagacctctttcagaaaaccagaacatgcaggatccagacgcctcggacgagggcaagccggtagtcagtgacgagcagctatctcgctggctgggtaccaactccccccgagatttggaagagaggcgcaagcttatgatggctgtagtgctagtaactgtggagctggagtgtctgcgccgctttttcaccgaccctgagaccctgcgcaagctagaggagaacctgcactacacctttagacatggcttcgtgcggcaggcatgcaagatctccaacgtggagcttaccaacctggtttcttacatgggcattttgcatgagaaccgactagggcagagcgtcctgcacaccacccttaaaggggaggcccgccgtgactacatccgagactgtgtctacctctacctctgccatacctggcaaactggtatgggtgtgtggcaacagtgtttggaagagcagaacctaaaagagctggacaagctcttgcagagatccctcaaagccctgtggacaggttttgatgagcgcaccgtcgcctcggacctggcagacatcatcttccccgagcgtctcagggttactctgcgaaacggcctgccagactttatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctgttccgcctggccaactacctctcctaccactcggatgttatagaggatgtgagcggagacggcctgctggaatgccactgccgctgcaatctttgcacaccccaccgctcccttgcctgcaacccccagttgctgagcgagacccagattatcggcaccttcgagctgcagggtcccagaagtaaaggcgaggggtcttctccggggcagagtttgaaactgacaccggggctgtggacctccgcctacctgcgcaagtttcaccccgaggactaccatccctatgagatcaggttctatgaggaccaatcacatcctcccaaagtcgagctctcagcctgcgtcatcacccagggagcaattctggcccaattgcaagccatccaaaaatctcgccaagaatttctgctaaaaaagggaaacggggtctaccttgaccctcagaccggtgaggagctcaacacaaggttcccccaggatgtcccatcgccgaggaagcaagaagttgaaggtgcagctgtcgcccccagaggatatgaaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgattcccaaacccgaccaccgcttccaagaccggtaagaaggagcgacagggatacaagtcctggcgtggacataaaaacgctatcatctcctgcttgcatgaatgcgggggcaacatatccttcacccggcgatacctgctcttccaccacggtgtaaacttcccccgcaatatcttgcattactaccgtcacctccacagcccctactgcagtcagcaagtcccggcaaccccgacagaaaaatacagcagcgacaacggtgaccagaaaaccagcagttagaaaatccacaacaagtgcaccaggaggaggactgaggatcacagcgaacgagccagcgcagaccagagagctgaggaaccggatctttccaaccctctatgccattttccagcagagtcgggggcaagagcaggaactgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgctcattttgaaaacggcgggaatcacgtcacccttggcacctgtcctttgcccttgtcatgagtaaagagattcccacgccttacatgtggagctatcagccccaaatggggttggcagcaggcgcttcccaggactactccacccgcatgaattggcttagcgccgggccctcaatgatatcacgggttaatgatatacgagcttatcgaaaccagttactcctagaacagtcagctctcaccaccacaccccgtcaacaccttaatccccgaaattggcccgccaccctggtgtaccaggaaaatcccgctcccaccaccgtactacttcctcgagacgcccaggccgaagttcagatgactaacgcaggtgtacagctggcgggcggttccgccctatgtcgtcaccgacctcaacagagtataaaacgcctggtgattagaggccgaggtatccagctcaacgacgagtcggttagctcttcgcttggtctgcgaccagacggagtcttccaaatcgccggctgtgggagatcttccttcactcctcgtcaggctgtgctgactttggagagttcgtcctcgcagccccgctcgggcggcattggaactctccagtttgtggaggagtttactccctctgtctacttcaaccccttctccggctctcctggccagtacccggacgagttcataccaaacttcgacgcaatcagcgagtcagtggatggctatgattgatgtctaatggtggtgcggctgagctagctcgactgcgacacctagaccactgccgccgctttcgctgcttcgcccgggaactcaccgagttcatctacttcgaactctccgaggagcaccctcagggtccggcccacggagtgcggattaccatcgaagggggaatagactctcgcctgcatcgcatcttctcccagcggcccgtgctaattgaacgcgaccagggaaatacaaccatctccatctactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctttcatccaggactctaactctaccttaccagcaccctccactactaaccttcccgaaacaaacaagcttgcatctcatctgcaacaccgcctttcacgaagccttctttctgccaatactaccactcccaaaaccggaggtgagctccgcggtcttcctactgacgacccctgggtggtagcgggttttgtaacgttaggagtagttgcgggtgggcttgtgctgatcctttgctacctatacacaccttgctgtgcatatttagtcatattgtgctgttggtttaagaaatgggggccatactagtcgtgcttgctttactttcgcttttgggtctgggctctgctaatctcaatcctctcgatcacgatccatgtttagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttccccagtggtatactgtctctgtccgaggtcctgacggttccatccgcattagtaacaacactttcattttttctgaaatgtgcgatctggccatgttcatgagcagacagtatgacctatggcctcccagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaattaacagtgccaactatgacaataattaaaatggctaataaagcattagaaaattttacatcaccaacaacacccaatgaaaaaaacattccaaattcaatgattgcaattattgcggcggtggcattgggaatggcactaataataatatgcatgctcctatatgcttgttactataaaaagtttcaacataaacaggatccactactaaattttaacatttaattttttatacagatgatttccactacaatttttatcattactagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtacaaaattttcatgcaacggaagagacttgaccattattaacataacatcaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttccaaaaatcgctttaagtaattccacagccgctcccaatacaattcctaaatcaacaattggcatcattactgccgtggtagtgggattaatgattatatttttgtgtataatgtactacgcctgctgctatagaaaacatgaacaaaaaggtgatgcattactaaattttgatatttaattttttatagaattatgatattgtttcaatcaaataccactacctcctatgcatacacaaacattcagcctaaatacgctatgcaactagaaatcacaatactaattgtaattggaattcttatactatctgttattctttattttatattctgccgtcaaatacccaatgttcatagaaattctaaaagacgtcccatctattctcctatgattagtcgtccccatatggctctgaatgaaatctaagatctttttttttttctcttacagtatggtgaacatcaatcatgatccctagaaatttcttcttcaccatactcatctgtgcttttaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtgcgaattgcctacctacgtcaccatcccgaataccgcaatcaaaatgttgcggcacttcttaggcttatttaaaaccatgcaggctatgctaccagtcattttaattttgctactaccctgcattcccctagcttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagaaccagatgaacatattccactacaacacatacaacaaccactagcactggtacagtatgaaaatgagccacaaccttcactgccccctgccattagttacttcaacctaaccggcggagatgactgacccaatcgccacatcatccaccgctgccaaggagctgctggacatggacggacgtgcctcagaacagcgactcatccaactacgcattcgtcagcagcaggaacgagcagtaaaagagctaagggatgccattgggattcaccagtgcaaaaaaggcatattctgcttagtaaaacaatccaaaatctcctacgagatcaccgctactgaccatcgtctctcatacgagctcggtccgcagcgacaaaaattcacctgcatggtgggaatcaaccccatagttatcacccagcagtctggagatactaagggttgtatccagtgttcctgtgattccaccgagtgcatctacacactgctgaagaccctctgcggccttcgagacctcctacccatgaactaatcattgcccctaccttacccaatcaaaatattaataaagacacttacttgaaatcagcaatacagtctttgtcaaaactttctaccagcagcacctcaccctcttcccaactctggtactctaaacgtcggagggtggcatactttctccacactttgaaagggatgtcaaattttatttcctcttctttgcccacaatcttcatttctttatccccagatggccaagcgagctcggctaagcacttccttcaacccggtgtacccttatgaagatgaaagcagctcacaacacccatttataaatcctggtttcatttcccctgacgggttcacacaaagtccaaacggggttttaagtcttaaatgtgttaatccacttaccactgcaagcggctccctccaacttaaagtgggaagtggtcttacagtagacactactgatggatccttagaagaaaacatcaaagttaacacccccctaacaaagtcaaaccattctataaatttaccaataggaaacggtttgcaaatagaacaaaacaaactttgcagtaaactcggaaatggtcttacatttgactcttccaattctattgcactgaaaaataacactttatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactgacaacaaaaataaagttcaacattttttattgaaattccttttacagtattcgagtagttattttgcctcccccttcccatttaacagaatacaccaatctctccccacgcacagctttaaacatttggataccattagagatagacatagttttagattccacattccaaacagtttcagagcgagccaatctggggtcagtaatacataaaaatgcatcgggatagtcttttaaagcgctttcacagtccaactgttgcggatgcgactccggagtctgaatcacggtcatctggaagaagaacgatgggaatcataatccgaaaacggaatcgggcgattgtgtctcatcaaacccacaagcaaccgctgtctgcgtcgctccgtgcgactgctgtttatgggatcggggtccgcagtgtcctgaagcatgattttaatagcccttaacattaactttctggtgcgatgcgcgcagcaacgcattctgatttcacttagattactacagtaggtacagcacattatcacaatattgtttaataaaccataattaaaagcgctccagccaaaactcatatctgatataatcgcccctgcatgaccatcataccaaagtttaatataaattaaatgtcgttccctcaaaaacacactacccacatacatgatctcttttggcatgtgcatattaacaatttgtctgtaccatggacaacgttggttaatcatgcaacccaatataaccttccggaaccacactgccaacaccgctcccccagccatgcattgaagtgaaccctgctgattacaatgacaatgaagaacccaattctctcgaccatgaatcacttgagactgaaaaatatctatagtagcacaacaaagacataaatgcatgcatcttctcataatttttaactcctctggatttaaaaacatatcccaaggaatgggaaactcttgcagaacagtaaagctggcagaacaaggaagaccacgaacacaacttacactatgcatagtcatagtatcacaatctggcaacagcgggtggtcttcagtcatagaagctcgggtttcattttcctcacatcgtggtaattgggctctggtgtaagggtgatgtctggcgcatgatgtggagcgtgcgcgcaaccttgtcataatggagttgcttcctgacattctcgtattttgtatagcaaaacgctgccctggcacaacacactcttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgcgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttgaattattcgtgtcagttcttgtggtaaatccaaaccacacattacaaacaggtcccggagggcgccctccaccaccattcttaaacacaccctcataatgacaaaatatcttgctcctgtgtcacctgtagcaaattaagaatggcatcatcaattgacatgcccttggctctaagttcttctctaagttctagttgtagatactctctcatattatcaccaaactgcttagccagaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaagaaacattcaaaaccgttgggatgcaaatacaataggttaccgcgctgcgctccaacattgttagttttgaattagtctgcaaaataaaagaaacaagcgtcatatcatagtagcctgtcgaacaggtggaaaaatcagtctttccatcacaagacaagccacagggtctccagctcgaccctcgtaaaacctgtcattgtgattaaacaacagcaccgaaagttcctcgcggtggccagcatgaataattcttgatgaagcatacaatccagacatgttagcatcagttaaagagaaaaaacagccaacatagcctctgggtataattatgcttaattttaagtatagcaaagccacccctcgcggatacaaagtaaaaggcacaggagaataaaaaatataattatttctctgctgctgttcaggcaacgttgctcccggtccctctaaatagacatacaaagcctcatcagccatggcttaccaggcaaagtacagcgggcgcacaaagcacaagctctaaagaagctctaaaaacactctccaacctctccacaatatatacacaagccctaaactgacgtaatgggagtaaagtgaaaaaaaaataccgccaagcccaacacacaccccgaaactgcgtcagcaggaaaaagtacagtttcacttccgcattcccaacaagcgtaacttcctctttctcatggtacgtcacatccgattaacttgcaacgtcattttcccacggtcgcgccgccccttttagccgttaaccccgcagccaatcaccacacagcgcgcacttttttaaattacctcatttacatgttggcaccattccatctataaggtatattatatagatagcctgcag

SEQ ID NO: 5 - DNA, 35564 bp, Adenovirus B7
  MISC_FEATURE (1)..(35564): Complete Genome
agaccaaaacgatctcaagcgatcgcgtttaaacaagggcgaattccagcacactggcggccgttactagtggatccgagctcggtaccaagcttgatgcatagcttgagtattctatagtgtcacctaaatagcttggccatcatcaataatataccttatagatggaatggtgccaacatgtaaatgaggtaatttaaaaaagtgcgcgctgtgtggtgattggctgtggggtgaatgactaacatgggcggggcggccgtgggaaaatgacgtgacttatgtgggaggagttatgttgcaagttattgcggtaaatgtgacgtaaaaggaggtgtggtttgaacacggaagtagacagttttcccacgcttactgataggatatgaggtagttttgggcggatgcaagtgaaaattctccattttcgcgcgaaaactgaatgaggaagtgaatttctgagtcatttcgcggttatgacagggtggagtatttgccgagggccgagtagactttgaccgtttacgtggaggtttcgattaccgtgtttttcacctaaatttccgcgtacggtgtcaaagtcctgtgtttttacgtaggtgtcagctgatcgctagggtatttaaacctgacgagttccgtcaagaggccactcttgagtgccagcgagaagagttttctcctccgcgccgcaagtcagttctgcgctttgaaaatgagacacctgcgcttcctgccacaggagattatctccagtgagaccgggatcgaaatactggagtttgtggtaaataccctaatgggagacgacccggaaccgccagtgcagccttttgatccacctacgctgcacgatctgtatgatttagaggtagacgggccggaggatcccaatgagggagctgtgaatgggttttttactgattctatgctgctagctgccgatgaaggattggacataaaccctcctcctgagacccttgtcaccccaggggtggttgtggaaagcggcagaggtgggaaaaaattgcctgatctgggagcagctgaaatggacttgcgttgttatgaagagggttttcctccgagtgatgatgaagatggggaaactgagcagtccatccataccgcagtgaatgagggagtaaaagctgccagcgatgtttttaagttggactgtccggagctgcctggacatggctgtaagtcttgtgaatttcacaggaataacactgggatgaaagaactattgtgctcgctttgctatatgagaatgcactgccactttatttacagtaagtgtatttaagtgaaatttaaaggaatagtgtagctgtttaataactgttgaatggtagatttatgtttttacttgcgattttttgtaggtcctgtgtctgatgatgagtcaccttctcctgattcaactacctcacctcctgaaattcaggcgcccgcacctgcaaacgtatgcaagcccattcctgtaaagcctaagcctgggaaacgccctgctgtggataagcttgaggacttgttggagggtggggatggacctttggaccttagtacccggaaactgccaaggcaatgagtgccctgcagctgtgtttatttaatgtgacgtcatgtaataaaattatgtcagctgctgagtgttttattacttcttgggtggggtcttggatatataagtaggagcagatctgtgtggttagctcacagcaacttgctgccatccatggaggtttgggctatcttggaagacctcagacagactaggctactactagaaaacgcctcggacggagtctctggcctttggagattctggttcggtggtgatctagctaggctagtgtttaggataaaacaggactacagggaagaatttgaaaagttattggacgacattccaggactttttgaagctcttaacttgggccatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctgggagtagcagggatactgagacacccaccgaccatgccagcggttctgcaggaggagcagcaggaggacaatccgagagccggcctggaccctccggtggaggagtagctgacctgtttcctgaactgcgacgggtgcttactaggtctacgaccagtggacagaacaggggaattaagagggagaggaatcctagtgggaataattcaagaaccgagttggctttaagtttaatgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagcttttagatgttgtatgatgggtatgtggccaggggttgtcggcatggaagcaataacacttatgaatattaggtttagaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtgaagagtcagttgtctgtgaagaaatgcatgtttgagagatgtaatcttggcatactgaatgaaggtgaagcaagggtccgccactgcgcagctacagaaactgcctgcttcattctaataaagggaaatgccagtgtgaagcataatatgatctgtggacattcggatgagaggccttatcagatgctaacctgcgctggtggacattgcaatattcttgctaccgtgcatatcgtttcacatgcacgcaagaaatggcctgtatttgaacataatgtgattaccaagtgcaccatgcatataggtggtcgcaggggaatgtttatgccttaccagtgtaacatgaatcatgtgaaggtaatgttggaaccagatgccttttccagagtgagcgtaacaggaatctttgatatgaatattcaactatggaagatcctgagatatgatgacactaaaccaagggtgcgcgcatgcgaatgcggaggcaagcatgctagattccagccggtgtgcgtggatgtgactgaagacctgaggcccgatcatttggtgcttgcctgcactggagcggagttcggttctagtggtgaagaaactgactaaagtaagtagtgggggcaaaatgtggatggggactttcaggttggtaaggtggacaaattgggtaaattttgttaatttctgtcttgcagctgccatgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattacggaagcattgttgccaattccagttcctctaataatccttcaaccctggctgaggacaagctacttgttctcttggctcagctcgaggccttaacccaacgcttaggcgaactgtctaagcaggtggcccagttgcgtgagcaaactgagtctgctgttgccacagcaaagtctaaataaagatctcaaatcaataaataaagaaatacttgttataaaaacaaatgaatgtttatttgatttttcgcgcgcggtatgccctggaccatcggtttcgatcattgagaactcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatccggggtgaaattatatgcattttggactggatcttgaggttggcaatgttgccgcctagatcccgtctcgggttcatattgtgcaggaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctgtggcccgggagcatagtttccctcacatatttgcatttcccaggctttcagttcagagggggggatcatgtccacctgcggggctataaaaaataccgtttctggagccggggtgattaactgggatgagagcaaattcctaagcagctgagacttgccgcacccggtgggaccgtaaatgaccccaattacgggttgcagatggtagtttagggagcgacagctgccgtcctcccggagcaggggggccacttcgttcatcatttcccttacatggatattttcccgcaccaagtccgttaggaggcgctctcccccaagtgatagaagctcctggagcgaggagaagtttttcagcggcttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgggcgtccagcgctgccagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgatcggcgccctgcatgtcggccaggtagcagtttaccataagttcgtagttgagcgcctcggccgcgtggcctttggcacggagcttacctttggaagttttatggcaggcagggcagtagatacatttgagggcatacagcttgggcgcgaggaaaatggattcgggggagtatgcatccgcaccgcaggagacgcagacggtttcgcactccacaagccaggtcagatccggctcatcagggtcaaaaacaagttttccgccatgttttttgatgcgtttcttacctttggtttccatgagttcgtgtccacgctgggtgacaaagaggctgtccgtgtccccgtagaccgactttatgggcctgtcctcgagcggagtgcctcggtcctcttcgtagaggaatccagcccactctgatacaaaagcgcgtgtccaggccagcacaaaggaggccacgtgggaggggtagcggtcgttgtcaaccaggggatccaccttctctacggtatgtaaacacatgtccccctcctccacatccaagaatgtgattggcttgtaagtgtaggccacgtgaccaggggtccccgccgggggggtataaaagggggcggacctctgttcgtcctcactgtcttccggatcgctgtccaggagcgccagctgttggggtaggtattccctctcgaatgcgggcatgacctctgcactcaggttgtcagtttctaggaacgaggaggatttgatattgacagtaccagcagagatgccttttataagactctcgtccatctggtcagaaaacacaatcttcttgttgtccagcttggtggcaaatgatccatagagggcattggatagaagcttggcgatggagcgcatggtttggttcttttccttgtccgcgcgctccttggcggcgatgttaagctggacgtactcgcgcgccacacatttccattcaggaaagatggttgtcagttcatccggaactattctgactcgccatcccctattgtgcagggttatcagatccacactggtggccacctcgcctcggaggggctcattggtccagcagagtcgacctccttttcttgaacagaaaggggggagggggtctagcatgaactcatcaggggggtccgcatctatggtaaatattcccggtagcaaatctttgtcaaaatagctgatggtggcaggatcatccaaggtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacagcgcccccctctgatgcttgctcgcacatagtcatagagttcatgtgagggggcgagaagacccgggcccagattggtgcggttgggtttttccgccctgtaaacgatttggcgaaagatggcatgggaattggaagaaatagtaggtctctggaatatgttaaaatgggcatgaggtaggcctacagagtctcttatgaagtgggcatatgactcttgcagcttggctaccagctctgcggtgacgagtacatccagggcacagtagttgagagtttcctggatgatgtcataacgcggttggcttttcttttcccacagctcgcggttgagaaggtattcttcgtgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttgaggaattgatacttgaagtcgatgtcatcacaggccccctgttcccagagttggaagtccgcccgcttcttgtaggcgggattgggcaaagcgaaagtaacatcattgaagaggatcttgccggccctgggcatgaaatttcgggtgattttaaaaggctgagggacctctgctcggttattgataacctgagcggccaagacgatctcatcaaagccattgatgttgtgccccactatgtacagttctaagaatcgaggggtgcccctgacatgaggcagcttcttgagttcttcaaaagtgagatctgtagggtcagtgagagcatagtgttcgagggcccattcgtgcatgtgagggttcgctttgaggaaggaggaccagaggtccactgccagtgctgtttgtaactggtcccggtactgacgaaaatgctgtccgactgccatcttttctggggtgatgcaatagaaggtttgggggtcctgccgccagcgatcccacttgagtttcatggcgatgtcataggcgatgttaacgagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatttcctgccaccagttggaggaatggctgttgatgtgatggaagtagaactccctgcgacgcgccgagcattcatgcttgtgcttgtacagacggccgcagtactcgcagcgattcacgggatgcacctcatgaatgagttgtacctgacttcctttgacgagaaatttcagtggaaaattgaggcctggcgcttgtacctcgcgctctactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattgacttgcatgatcttttcgagggcgtgagggaggttcagatggtacttgatctccacgggtccgttggtggagatgtcgatggcttgcagggttccgtgccccttgggcgctaccaccgtgcccttgtttttccttttgggcggcggtggctctgttgcttcttgcatgtttagaagcggtgtcgagggcgcgcaccgggcggcaggggcggctcgggacccggcggcatggctggcagtggtacgtcggcaccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgcgaggtcgttggagatgcgcccaatgagttgagagaaagcattcatgcccgcctcgttccagacgcggctgtagaccacagcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttgaaaaactgggagttacgcgcggacacggtcaactcctcttccagaagacggataagttcggcgatggtggtgcgcacctcgcgctcgaaagctcctaggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatagtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgattgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctcttgcgagggtgagacgatgctgctggtgatgaaattaaaataggcagttttaagacggcggatggtggcgaggagcaccaggtctttgggtccggcttgttggatgcgcaggcgatgagccattccccaagcattatcctgacatctggccagatctttatagtagtcttgcatgagtcgttccacgggcacttcttcttcgcccgccctgccatgcatgcgagtgatcccgaacccgcgcatgggctggacaagtgccagatccgctacaaccctttcggcgaggatggcttgctgcacctgggtgagggtggcttgaaagtcgtcaaagtccacgaagcggtggtaggccccggtgttgattgtgtaggagcagttggccatgactgaccagttgactgtctggtgcccagggcgcacgagctcggtgtacttcaggcgcgagtatgcgcgcgtgtcaaagatgtaatcgttgcaggtgcgcaccaggtactggtagccgatgagaaagtgtggcgatggctggcggtacaggggccatcgctctgtagccggggctccgggggcgaggtcttccagcatgaggcggtggtagccgtagatgtacctggacatccaggtgataccggaggcggtggtggatgcacgtgggaactcgcgcacgcggttccagatgttgcgcagcggcatgaagtagttcatggtaggcacggtctggccagtgaggcgcgcgcagtcattgacgctctgtagacacggagaaaacgaaagcgatgagcggctcgactccgtggcctgggggaacgtgaacgggttgggtcgcggtgtaccccggttcgagtccaaagctaagcaatcacactcggatcggccggagccgcggctaacgtggtattggctatcccgtctcgacccagccgacgaatatccagggtacggagtagagtcgtttttgctgcttttttcctggacgtgtgccattgccacgtcaagctttacaacgctcagttctcgggccgtgagtggctcgcgcccgtagtctggagaatcagtcgccagggttgcgttgcggtatgcccccggttcgagcctaagcgcggctcgtatcggccggtttccgcgacaagcgagggtttggcagcccagtcatttccaagaccccgccagccgacttctccagtttacgggagcgagcccttttttttttttgtttttgtcgcccagatgcatccagtgctgcgacagatgcgcccccagcaacaggccccttctcagcaacagccacaaaaggctcttcttgctcctgcaactactgcagctgcagccgtgagcggcgcgggacagcccgcctatgatctggacttggaagagggcgagggattggcgcgcctgggggctccatcgcccgagcggcacccgcgggtgcaactaaaaaaggactctcgcgaggcatacgtgccccagcagaacctgtttagggacaggagcggcgaggagccagaggagatgcgagcatctcgatttaacgcgggtcgcgagctgcgccacggtctggatcgaagacgggtgctgcaagacgaggattttgaggtcgatgaagtcacagggatcagcccagctagggcacatgtggccgcggccaacctagtctcggcctacgagcagaccgtgaaggaggagcgcaacttccaaaaatcttttaacaaccatgtgcgcaccctgattgcccgcgaggaagtgaccctgggtctgatgcatctgtgggacctgatggaggctatcgcccaaaaccccactagcaaaccactgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtgaagatagatgggttttacatgcgcatgactctaaaggtactaactctaagcgacgatctgggggtgtatcgcaatgacaggatgcatcgcgcggtgagcgccagtaggaggcgcgagctgagcgacagagaacttatgcacagcttgcaaagagctctaacgggggccgggactgatggggagaactactttgacatgggagcggacttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttcggccatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcaaaccaacctggaccggatggtgaccgatgtgcgcgaggccgtgtctcagcgcgagcggttccagcgcgacgccaacttggggtcgttggtagcgctaaacgcttttctcagcacccagcccgccaacgtgccccgtggtcagcaagactatacaaactttttgagtgcattgagactcatggtagctgaggtgccccagagcgaggtgtaccagtccgggccagattacttcttccagaccagcagacagggcttgcagacagtgaacctgactcaggctttcaaaaacctgaagggtctctggggagtgcacgccccagtaggggatcgcgcgaccgtgtctagcttgctgactcccaactcccgcctgctgctgctgctggtatccccctttactgacagcggtagcatcgaccgcaactcctacttgggctacctgcttaacctgtatcgcgaggccataggacagagccaggtggacgaacagacctatcaagaaatcacccaagtgagccgcgccctgggtcaggaagacacgggcagtttggaagccaccctgaacttcttgttaaccaaccggtcgcagaagatccctcctcagtatgcgcttaccgctgaggaggagcggatccttagatacgtgcaacagagcgttggattgttcctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtagacagcagcatattctccccgcctcccggttatacagtttggaagaaggaagggggcgatacaaggcactcttccgtgtcgctgtccagaacggctggtgctgccgcgaccgtgcccgaagctgcaagtcctttccctagcttgcccttttcactaaacagcgttcgcagcagtgaacttgggagaataacccgcccgcgcttgatgggcgaggatgagtacttgaatgactctttgttgaggccagagagggaaaagaacttccccaacaatggaatagagagcctggtggataagatgagtagatggaagacctatgcgcaggatcacagagacgagcccaaaatcttgggggctacaagcagaccgacccgtagacgccagcgccacgacaggcagatgggtcttgtgtgggacgatgaggactctgccgatgatagcagcgtgttggacttgggtggaagaggagggggcaacccgttcgctcatctgcgtcccagattcgggcgcatgttgtaaaagtgaaagtaaaataaaaaggcaactcaccaaggccatggcgaccgagcgtgcgttcgttcttttttgttatctgtgtttagtacgatgaggagacgagccgtgctaggcggagcgatggtgtatccggagggtcctcctccttcttacgagagcgtgatgcagcaacaggcggcgatgatacagcccccactggaggctcccttcgtacccccgcggtacctggcgcctacggaagggagaaacagcattcgttactcggagctgtcgcccctgtacgataccaccaagttgtatctggtggacaacaagtcggcggacatcgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaggctcctgaaggtgttatagtaaatgacacctatgatcataaagaggatatcttaaagtatgagtggtttgagttcactttaccagaaggcaacttctcagccaccatgaccattgacctgatgaacaatgccatcattgacaactacctggaaattggcagacaaaatggagtgctggaaagtgacattggtgttaagtttgacactagaaactttaggctcgggtgggaccccgaaactaagttaattatgccaggagtctacacttatgaggcattccatcctgacattgttttgctgcctggctgcggggtagactttactgaaagccgacttagcaacttgcttggcatcaggaaaagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgataatataactagaggagatacctatataactgaaaaacaaaaacgtgaagctgcagctgctgaagttaaaaaagagttaaagatccaacctctagaaaaagacagcaagagtagaagctacaatgtcttggaagacaaaatcaacacggcctaccgcagctggtacctgtcctacaattacggtaaccctgagaaaggaataaggtcttggacactgcttaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttttaaaaaacaaaaaatgtccattctcatctcgcccagtaataataccggttggggactgtatgcgcccaccaagatgtatggaggcgcccgcatacgctctacccagcaccctgtgcgcgttcgcggtcatttccgcgctccatggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcattgctaggcgccacagggctactaccgccatgcgagctgcaaaagctattctgcggagggccaaacgtgtggggcgaagagccatgcttagagcggccagacgcgcggcttcaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccaccggtgaaggatgaaaaaaagccccgcaaaatcaagcgggtcaaaaataacaaaaaggaagaagatgacgctgatgggctggtggagtttgtgcgcgagttcgccccaagacggcgcgtgcagtggcgcgggcgcaaagtgcgtcaagtgctcagacccgggaccactgtggtctttacacctggcgagcgttccagcactacttttaaacggtcctatgatgaggtgtacggggatgacgatattcttgagcaggcggcagaccgccttgacgagtttgcttatggcaagcgcactagatccagtcccaaagaggaggcggtgtccattcccttggatcatggaaatcccacccccagcctcaaaccagtcaccctgcagcaagtgctgcccgtgcctgcgcggagaggcgtaaagcgcgagggtgaggacctatatcccaccatgcagctaatggtgcccaagcgccagaggctagaagacgtactggagaaaatgaaagtggatgccgatatccagcctgaggttaaagtaagacctattaaggaagtggcgccaggtttgggagtacaaaccttcgacatcaagattcccaccgagtccatggaagtgcagaccgaacctgcaaaacccacaaccacctcaattgaggtgcaaacggaaccctggatgcccgcgcccgttgccgcccccagcaccactcgaagatcacgacgaaagtacggcccagcaagtctgctaatgcccaactatgctctgcacccatccatcattcccactccgggttacagaggcactcgctactatcgaaaccggagcaacacctctcgccgccgcaaaccacctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcagacgattagatggtggctttttgccagctcttatacccatcatcgccgcagcgatcggggcgataccaggcatagcttccgtggcggttcaggcctcgcagcgccactaacattggaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatctggccaaccaggctgtacaaaaacagataaacagccgactggacccgccgcccgcaacccctggtgaaatggaagtggaggaagagcttcctccgctggaaaagcggggcgacaagcgtccgcgacccgagctggagcagacgctggtgacgcgcgcagacgagcccccttcatacgaggaggcagtaaagctaggaatgcccactactaggcccgtagctcacatggctaccggggtgatgaaaccttctcagtcacatcgacccgccaccttggacttgcctcctccccctgcttctgcggcgcttgttcccaaacctgtcgctaccagaaagcccaccgccgtacagcccgtcgccgtagccagaccgcgtcctgggggcacaccgcgcccgaaagcaaactggcaaagtactctgaacagcatcgtgggtctgggcgtgcagagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctgagtccgggtctggtgcagttcgcccgtgcaacagacacctacttcagtatggggaacaaatttagaaaccccacagtggcgcccacccacgatgtgaccaccgaccgtagccagcgactgatgctgcgcttcgtacccgttgaccgggaagacaatacctactcttacaaagttcgctacacgctggctgtaggcgacaacagagtgcttgacatggccagcacattctttgacattcggggggtgcttgatagaggtcctagctttaagccatattctggcacagcttacaattcactggctcctaagggcgcgcccaatacatctcagtggatagttacagcaggagaagaaagagcagtaactaccaccacaaacacatttggcattgcttccatgaagggagacaatattactaaagaaggtttagaaattgggaaagacattactgcagacaacaagcccatttatgccgataaaacatatcagccagagcctcaagttggagaagaatcatggactgatactgatggaacaaatgaaaagtttggaggtagagctcttaaaccagctaccaaaatgaagccatgctacgggtcttttgcaagacctacaaatataaaagggggccaagctaaaaacagaaaagtaaaaccaaccgaaggagatgttgagactgaggagccagatattgatatggaattttttgatggtagagaagctgctgacgctttttcgcctgaaattgtgctttacacggaaaatgtcaatttagaaactccagacagccatgtagtttacaagccaggaacttctgatgataactctcatgcaaatttgggtcaacaagccatgcctaacagacccaattacattggcttcagggataactttgtaggcctaatgtactacaacagtactggaaatatgggagttttggctggccaagcatcacaactgaatgcagtggttgacttgcaggacagaaacactgaactgtcatatcagcttttgcttgattctctgggagacagaaccagatacttcagtatgtggaaccaggctgtggacagttatgatcccgatgttcgcattattgaaaatcacggcatcgaggatgaactgcctaattactgttttcctctggatggcataggaccagcgaaaacatatcaaggcattaaatctaaagacaatggatgggaaaaagatgataatgtttctaaatctaatgaaatagccataggcaacaaccaggctatggaaattaatatccaagctaacctttggagaagttttctgtactccaatgtggctttgtaccttccagatgtttacaagtacacgccaactaacattactctgcccgccaacaccaacacctatgagtacatgaacgggcgagtggtatccccatctctggttgattcatacatcaacattggcgccaggtggtctcttgacccaatggacaatgtgaatccattcaaccaccaccgcaatgctggtctgcgctaccggtccatgcttctgggcaatggtcgttatgtgcctttccacatacaagtgcctcaaaaattctttgctgtcaagaacctacttcttctacctggctcctacacctatgagtggaacttcagaaaggatgtgaacatggtcctgcaaagttcccttggaaatgacctcagaacagatggtgctaccataagtttcaccagcatcaatctgtatgccaccttcttccccatggctcacaacacagcttccacccttgaagccatgctgcgcaacgataccaatgatcagtcattcaacgactacctctctgcagctaacatgctttaccccatccctgccaatgcaaccaacattccaatttccatcccatctcgcaactgggcagccttcaggggctggtccttcactaggctcaaaaccaaggagactccatctcttggatcagggttcgatccctacttcgtatattctggatctattccctacctggatggcaccttttaccttaaccacactttcaagaaggtctccatcatgtttgactcctcagtcagctggcctggcaatgacaggctgttgagcccaaatgagtttgaaatcaagcgcactgtggacggggaagggtacaatgtggcccaatgtaacatgaccaaagactggttcctggttcagatgcttgccaactacaacattggctaccagggcttttacatccctgagggatacaaggatcgcatgtactcctttttcagaaacttccagcctatgagcaggcaggtggttgatgaggttaattacactgactacaaagccgtcaccttaccataccaacacaacaactctggctttgtagggtatcttgcacctactatgagacaaggggaaccttacccagccaattatccatacccgctcatcggaactactgccgttaagagtgtcacccagaaaaagttcctgtgtgacaggaccatgtggcgcattcccttctccagcaacttcatgtccatgggggcccttaccgacctgggacagaacatgctctatgccaactcagcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgacatgcgggtccggaaacggctccagcgagcaagagctcaaagccatcgtccgagacctgggctgcggaccctatttcctgggaacctttgacaagcgtttcccggggttcatggcccccgacaagctcgcctgtgccatagtcaacactgccggacgcgagacggggggagagcactggctggcttttggttggaacccgcgctccaacacctgctacctttttgatccttttgggttctcggatgagcggctcaaacagatttaccagtttgagtacgaggggctcctgcgccgcagtgcccttgctaccaaaaaccgctgcatcaccctggagaagtccacccaaagcgtgcagggtccgcgctcagccgcctgtggacttttttgctgtatgttccttcatgcctttgtgcactggcccgaccgccccatggacggaaaccccaccatgaagttgctgactggggtgtccaacagcatgctccaatcaccccaagtccagcccaccctgcgccgcaaccaggaggcgctatatcgcttcctaaacacccactcatcttactttcgttctcaccgcgcgcgcatcgaaagggccaccgcgtttgaccgtatgaatatgcaataagtcatgtaaaaccgtgttcaataaacagcactttatttttacatgcactgaggctctggtttttgctcattcgtctcatcattcactcagaagtcaaatggattctggcgggagtcatagtgacccgcgggcagggatacgttgcggaactgtaacctgttctgccacttgaactcgggtatcaccagcttgggaactggaatctcgggaaaggtgtcttgccacaactttctggtcagttgcagggcgccaagcaggtcaggagcagagatcttgaaatcacagttggggccggcattttggacacgggagtttcggtacactgggttgcaacactggaacaccatcaaggctgggtgtctcacgcttgccagcacggtcgggtcactgatggtagccacatccaagtcttcagcattggccatcccaaagggggtcatcttacaggtctgcctgcccatcacgggagcacagcctggcttgtggttgcaatcgcaatgaatggggatcagcatcatcctggcttggtcgggggttatccctgggtacacggccttcatgaaggcttcgtactgcttgaaagcttcctgagccttaattccctcggtgtagaacatcccacaggacttgctggaaaattggttagtagcacagttggcatcattcacacagcagcgggcatcgttgttggccaactggaccacatttctgccccagcggttctgggtgatcttggctctgtctgggttctccttcatagcgcgctgcccgttctcgctcgccacatccatctcgataatgtggtccttctggatcatgatagtgccatgcaggcatttcaccttgccttcgtaatcggtgcatccatgagcccacagagcgcacccggtgcactcccaattattgtgggcgatctcagaataagaatgcaccaatccctgcatgaatcttcccatcatcgctgtcagggtcttcatgctactaaatgtcagcgggatgccgcggtgctcctcgttcacatactggtggcagatacgcttgtactgctcgtgctgctctggcatcagcttgaaagaggttctcaggtcattatccagcctgtacctctccattagcacagccatcacttccatgcccttctcccaggcagataccaggggcaagctcaaaggattcctaacagcaatagaagtagctcctttagatataggatcattattgtcgatcttctcaacactcctcttgccatccttctcaatgatgcgcaccggggggtagctgaagcccacggccaccaactgaacctgttctctttcttcttcgctgtcctggctgatgtcttgcagagggacatgcttggtcttcctgggcttcttcttgggagggattgggggaggactgttgctccgttccggagacagggatgaccgcgaagtttcgcttaccagtaccacctggctctcgatagaagaattggaccccacgcgacggtaggtgttcctcttcgggggcagaggtggaggtgactgagatgggctgcggtctggccttggaggcggatggctggcagagcccattccgcgttcgggggtgtgctcccgttggcggtcgcttgactgatttcctccgcggctggccattgtgttctcctaggcagagaaacaacagacatggaaactcagccatcactgccaacatcgctgcaagcgccatcacacctcgcccccagcagcgacgaggaggaaagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaagcagatggcgatcaccaggaggctggcatcggggatcatgttgccgactacctcaccgggcttgggggggaggacgtgctcctcaaacatctagcaaggcagtcgaacatagttaaagacgcactactcgacctcaccgaagtgcccatcagtgtggaagagcttagccgcgcctacgagctgaacctcttttcgcctcagataccccccaagcggcagccaaacggcacctgcgaggccaaccctcgactgaacttctatccggcttttactgtccccgaagtgctggccacctaccacatcttttttaagaaccaaaagattccagtctcctgccgcgccaaccgcacccgcgccgatgcccttctcaacttgggtccgggagctcgcttacctgatatagcttccttggaagaggttccaaaaatctttgagggtctgggaagtgatgagactcgggccgcaaatgctctgcaacagggagagaatggcatggataaacatcacagcgctctagtggaactggagggtgacaatgcccggcttgcagtgctcaagcgcagtatcgtggtcacccattttgcctaccccgctgttaacctgccacccaaagtcatgagcgctgtcatggaccatctgctcatcaaacgagcaagtccactttcagaaaaccagaacatgcaggatccagacgcctcggacgatggcaagccggtagtcagtgacgagcagctatctcgctggctgggtaccaactccccccgagatttggaagaaaggcgcaagcttatgatggctgtagtgctagtaactgttgagctggagtgtctgcgccgcttttttaccgaccccgagaccctgcgcaaactagaggagaacctgcactacaccttcagacatggcttcgtgcgccaggcatgcaagatttccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaacctcaaagaactggacaagctcttgcagagatcccttaaagccctgtggacaggttttgacgagcgcaccgtcgcctcggacctggcggacatcatcttccccgagcgtcttagggttactctgcgaaacggcctgccagacttcatgagccagagcatgcttaacaactttcgctctttcatcctggaacgctccggtatcctgcctgtcacctgttgtgcgctgccctccgactttgtgcctcttacctaccgcgaatgcccaccgccgctatggagccactgctacctgttccgcctggccaactacctctcctaccactcggatgtgatagaggatgtgagcggagacggcctgctggaatgccactgccgatgcaatttatgcacaccccaccgctccctcgtctgcaacccacagttgctaagcgagacccagatcatcggcaccttcgagttgcagggtcccaacagtgaaggcgaggggtcttctccgggtcatagtctgaaactgacaccggggctgtggacctccgcctacctgcgcaagtttcatcccgaggactaccacccctatgagatcaggttctatgaggaccagacacatcctcccaaagtcgagctctcagcctgcgtcattacccagggagcaattctggcccaattgcaagccatccaaaaatcccgccaagaatttctgctaaaaaagggaagcggggtctaccttgacccccagaccggtgaggagctcaacacaagattcccccaggatgtcccatcgccgaggaagcaagaagctgaaggtgcagctgtcgcccccagaggatatgaaggaacactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggagcccagcggcggcccaacagtagatgggacgagaccgggcgattcccaaacccaaccaccgcttccaagaccggtaagaaggagcgacagggatacaaatcctggcgtggacataaaaacgctatcatctcctgcttgcatgaatgcgggggcaacatatcctttacccggcgatacctgctcttccaccacggtgtgaacttcccccgcaatatcttgcattactaccgtcacctccacagcccctactgcagtcagcaagtcccgacaaccccgacagaaaaagacagcagcgacaacggtgaccagaaaaccagcagttagaaaatccacaacaagtgcagcaggaggaggactgaggatcacagcgaacgagccagcgcagaccagagagctgaggaaccggatctttccaaccctctatgccatcttccagcagagtcgggggcaagagcaggaactgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgcttattcgaaaacggcgggaatcacgtcacccttggcacctgtcctttgccctcgtcatgagtaaagagattcccacgccttacatgtggagctatcagccccaaatggggttggcagcaggcgcctcccaggactactccacccgcatgaattggcttagcgccgggccctcaatgatatcacgggttaatgatatacgagcttatcgaaaccagttactcctagaacagtcagctctcaccaccacaccccgccaacaccttaatccccgaaattggcccgccgccctggtgtatcaggaaactcccgctcccaccaccgtactacttcctcgagacgcccaggccgaagttcatatgactaacgcaggtgtacagctggcgggcggttccgccctatgtcgtcaccgacctcaacagagtataaaacgcctggtgatcagaggccgaggtatccagctcaacgacgagtcggttagctcttcgcttggtctgcgaccagacggagtcttccaaatcgccggctgtggaagatcttccttcacccctcgtcaggctgtactgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattgatgtctaatggtggcgcggctgagctagctcgactgcgacacctagaccactgccgccgctttcgctgcttcgcccgggaactcaccgagttcatctacttcgaactccccgaggagcaccctcagggtccggcccacggagtgcggattaccatcgaagggggaatagactctcgcctgcatcgaatattctcccagcgacccgtgctgattgagcgcgaccagggaaatacaaccatctccatctactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctctgatccaggactctaactctaccttaccagcaccatccactactaaccttcccgaaactaacaagcttggatctcatctgcaacaccgcctttcacgaagccttctttctgccaatactaccactcccaaaaccggaggtgagctccgcggtctccctactgacgacccctgggtggtagcgggttttgtaacgttaggagtagttgcgggtgggcttgtgttaatcctttgctacctatacacaccttgctgtgcatatttagtcatattgcgctgttggtttaaaaaatgggggccatattagtcgtgcttgctttactttcgcttttgggtctgggctctgctaatctcaatcctcttgatcacgatccatgtctagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttcccgagtggtatactgtctctgtccgaggtcctgacggttccatccgcattagtaacaacacttttattttttctgaaatgtgcgatctggccatgttcatgagcagacagtatgacctatggcctcccagcaaagagaacattgtggcattttctattgcttattgcttggtaacatgcattatcactgctatcatttgtgtgtgcatacacttgcttatagttattcgccctagacaaagcaataaggaaaaagagaaaatgccttaacctttttactcataccttttctttacagcatggctactgttacagctctaattattgccagcattgtcactgtcgctcacgggcaaacaattgtccatattaccttaggacataatcacacccttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaatcaacagtgccaactatgacaataattaaaatggctaataaagcattagaaaattttacatcaccaacaacgcccaatgaaaaaaacattccaaattcaatgattgcaattattgcggcggtggcattgggaatggcactaataataatatgcatgttcctatatgcttgttgctataaaaagtttcaacataaacaggatccactactaaattttaacatttaattttttatacagatgatttccactacaatttttatcattactagccttgcggctgtaacttatggccgttcacacctaactgtacctgttggctcaacatgtacactacaaggaccccaacaaggctatgtcacttggtggagaatatatgataatggagggttcgctagaccatgtgatcagcctggtacaaaattttcatgcaacggaagagacttaaccataattaacataacatcaaatgagcaaggcttctattatggaaccaactataaagatagtttagattacaacattattgtagtgccagccaccacttctgctccccgcaaaaccactttctctagcagcagtgccaaagcaagcacaattcctaaaacagcttctgctatgttaaagcttcaaaaaatcgctttaagtaattccacagccgctcccaaaacaattcctaaatcaacaattggcatcattactgccgtggtagtgggattaattattatatttttgtgcataatgtactatgcctgctgctatagaaaacatgaacaaaaaggtgatgcattactaaattttgacatttaattttttatagaattatgatattgtttcaatcaaataccactaacactatcaatgtgcagactactttaaatcatgacatggaaaaccacactacctcctatgcatacataaacattcagcctaaatacgctatgcatctaaaaatcaccatactaattgtaattggaattcttatactatctgttattctttattttctattctcctatgattagtcgtccccatatagctctgaatgaaatctaagatcttttttttttctcttacagtatggtgaacaccaatcatgatccctagaaatttcttcttcaccatactcatctgtgctttcaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtacgaattgcctacctacgtcaccatcccgaataccgcaatcaaaatgttgcggcacttcttaggcttatttaaaaccatgcaggctatgctaccagtcattttaattctgctactaccctgcattgccctagcttccaccgccactcgcgctacacctgaacaacttagaaaatgcaaatttcaacaaccatggtcatttcttgattgctaccatgaaaaatctgatttccccacatactggatagtgattgttggaataattaacatactttcatgtacatttttctcaatcacaatataccccacatttaattttgggtggaattctcccaatgcactgggttacccacaagaaccagatgaacatattccactacaacacatacaacaaccactagcactggtagagtatgaaaatgagccacaaccttcactgcctcctgccattagttacttcaacctaaccggcggagatgactgaaatactcaccacctccaattccgccgaggatctgcttgatatggacggccgcgtctcagaacagcgactcgcccaactacgcatccgccagcagcaggaacgcgtgaccaaagagctcagagatgtcatccaaattcaccaatgcaaaaaaggcatattttgcttggtaaaacaagccaaaatatcctacgagatcaccgctactgaccatcgcctctcttacgaacttggcccccaacgacaaaaatttacatgcatggtgggaatcaaccctatagttatcactcagcaaagtggagatactaaggggtgcattcactgctcttgtgattccatcgagtgcacctacaccctgctaaagaccctatgcggcttaagagacctgctacccatgaattaaaaattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttaactcctctcctgtacccacaatcttcatgtctttcttcccagatgaccaagagagtccggctcagtgattccttcaaccctgtctacccctatgaagatgaaagcacctcccaacacccctttataaacccagggtttatttccccaaatggctttacacaaagcccagacggagttcttactttaaaatgtttaaccccactaacaaccacaggcgggtctctacagttaaaagtgggagggggtcttacaatagatgacaccgacggttttttgaaagaaaacataagtgccgccacaccactcgttaagactggtcactctataggtttgtcgctaggacccggattaggaacaaatgaaaacaaactttgtgccaaattgggagaaggacttacattcaattccaacaacatttgcattgatgacaatattaacaccctatggacaggagttaaccccaccacagccaactgtcaaataatggcctccagtgaatctaatgattgcaaattaattctaacactagttaaaactggagcccttgtcactgcatttgtttatgttataggagtatctaacgattttaatatgctaactacacataaaaatataaatttcactgcagagctgttttttgattctactggtaatttactaactagcctttcatccctaaaaactccacttaatcataaatcagggcaaaacatggctactggtgcccttactaatgctaaaggtttcatgcccagcacaactgcctatcctttcaatgttaattccagagaaaaagaaaactacatttacggaacttgttactacacagctagtgatcacactgcttttcccattgacatatctgtcatgcttaaccaaagagcattaaataatgagacatcatattgtattcgtgtaacttggtcctggaacacaggagttgccccagaagtgcaaacctctgctactaccctagtcacctctccatttaccttttactacattagagaagacgactgacaaaataaagtttaacttgtttatttaaaatcaattcataaaattcgagtagttattttgcctcccccttcccatttaacagaatacaccaatctctccccacgcacagctttaaacatttggataccattacagatagacatagttttagattccacattccaaacagtttcaaagcgagccaatctggggtcagtgatacataaaaatgcatcgggatagtcttttaaagcgctttcacagtccaactgctgcggatgcgactccggggtctggatcacggtcatctggaagaagaacgatgggaatcataatccgaaaacggaatcgggcgattgtgtctcatcaaacccacaagcagccgctgtctgcgtcgctccgtgcgactgctgcttataggatcgggatccacagtgtcctgaagcatgattttaatagcccttaacattaactttctggtgcggtgcgcgcagcaacgcattctgatttcacttagattactacagtaggtacagcacattatcacaatattgtttaataaaccataattaaaagcgctccagccaaaactcatatcagatataatcgcccctgcatgaccatcataccaaattttaatataaattaaatgtcgttccctcaaaaacacactacccacatacataatctcttttggcatgtgcatattaacaatctgtctgtaccatggacaacgttggttaatcatgcaacccaatataaccttccgaaaccacactgccaacaccgctcccccagccatgcattgaagtgaaccctgccgattacaatgacaatgaagaacccaattttctcgaccatgaatcacttgagaatgaaaaatatctatagtagcacaacaaagacataaatgcatgcatcttctcataattcttaactcctcgggatttagaaacatatcccaaggaatgggaaactcttgcagaacagtaaagctggcagaacaaggaagaccacgaacacaacttacactatgcatagtcatagtatcacaatctggcaacagcgggtggtcttcagtcatagaagctcgggtttcattttcctcacatcgtggtaactgggctctggtgtaagggtgatgtctggcgcaagatgtcgagcgcgcgcgcaaccttgtcataatggagttgcttcctgacattctcgtattttgtatagcaaaacgcggccctggcacaacacactcttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgcgtttcaagcagcacaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcttgcaccattcccagataattttcagctttccaaccttgaattattcgtgtcagttcttgtggtaaatccaaaccacacattacaaacaggtcccgaagggcgccctccaccaccattcttaaacacaccctcataatgacaaaatatcttgctcctgtgtcacctgtagcaaattaagaatggcatcatcaattgatatgcccttggctctaagttcttctctaagttctagttgtaaatactctctcatattatcaccaaactgcttagccagaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaaaaaacattcaaaacctctgggatgcaaatgcaataggttaccgcgctgcgctccaacattgttagttttgaattagtctgtaaaataaaagaaacaaacgtcatatcatagtagcctgtcgaacaggtggataaatcagtctttccatcacaagacaagccacagggtctccagctcgaccctcgtaaaacctgtcatcgtgattaaacaacagcaccgaaagttcctcgcggtggccagcatgaataattcttgatgaagcatataatccagacatgttagcatcagttaaagagaaaaaacagccaacatagcctctgggtataattatgcttaattttaagtttagcaaagccacccctcgcggatacaaagtaaaaggcacaggagaataaaaaatataattatttctctgctgctgttcaggcaacatcgcccctggtccctctaaatacacatacaaagcctcatcagccatggcttaccagacaaagtatagcgggcgcacaaagcacaagctctaaagaagctctaaagacgctctccaagctctccacaatatatacacaagccctaaactgacgtaatgggagtaaagtgtaaaaaatcccgccaagcccaacacacaccccgaaactgcgtcagcagggaaaagtacagtttcacttccgcaaacccaacacgcgtaacttcctctttctcacggtacgtcacatccgattaacttgcaacgtcattttcccacggccgccccgcccatgttagtcattcaccccacagccaatcaccacacagcgcgcacttttttaaattacctcatttacatgttggcaccattccatctataaggtatattattgatgatgggccagtgaattgtaatacgactcactatagggcgaattgggccctctagatgcatgctcgagcggccgccagtgtgatggatatctgcagaattcgcccttccttaattaacctgcag

SEQ ID NO: 6 - DNA, 35538 bp, Adenovirus B16
  MISC_FEATURE (1)..(35538): Complete Genome
cctgcaggcattatcaataatataccttatagatggaatggtgccaacatgtaaatgaggtaatttaaaaaagtgcgcgctgtgtggtgattggctgcggggtgaacggctaaaaggggcgggcaatgctgggatgtgacgtaacttatgtgggaggagttatgttgcaagttatcgcggtaaaggtgacgtaaaacgaggtgtggtttggacacggaagtagacagttttcccacgtttactgacaggatatgaggtagttttgggcggatgcaagtgaaaattctccattttcgcgcgaaaactgaatgaggaagtgaatttctgagtcatttcgcggttatgacagggtggagtatttgccgagggccgagtagactttgaccgtttacgtggaggtttcgattaccgtgtttttcacctaaatttccgcgtacggtgtcaaagtcctgtgtttttacgtaggtgtcagctgatcactagggtatttaaacctgtcgagttccgtcaagaggccactcttgagtgccagcgagaagagttttctcctccgcgctgcgagtcagttttgcgctttgaaaatgagacacctgcgattcctgccacaggagattatctccagcgagaccgggatcgaaatactggagtttgtggtaaataccctgatgggagatgacccggaaccgccagtgcagcctttcgatccacctacgctgcacgatctgtatgatttagaggtagacgggcctgatgatcccaatgaggaagctgtaaatgggttttttactgattctatgctgctagctgccgatgaaggattggacataaaccctcctcctgagacccttgataccccaggggtggttgtggaaagcggcagaggtgggaaaaaattgcctgatctgggagcagctgaaatggacttgcgttgttatgaagagggttttcctccgagtgatgatgaagacggggaaactgaacagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctgtttaataactgttgaatggtagatttatgtttttgcttgcgattttttgtaggtcctgtgtctgatgatgagtcaccttctcctgattcaactacctcacctcctgaaattcaggcgcccgtacctgcaaacgtatgcaagcccattcctgtgaagcctaagtctgggaaacgccctgctgtggataagcttgaggacttgttggagggtggggatggacctttggaccttagtacccggaaactgccaaggcaatgagtgccctgcagctgtgtttatttagtgacgtcatgtaataaaattatgtcagctgctgagtgttttattgcttcttgggtggggacttggatatataagtaggagcagatctgtgtggttagctcatagcaacctgctgccatccatggaggtttgggctatcttggaagacctgagacagactaggctactgctagaaaacgcctcggacggagtctctggcttttggagattctggttcggtggcgatctagctaggctagtgtttaggataaaacaggactatagggaagaatttgaaaagttattggacgacagtccaggactttttgaagctcttaacttgggccatcaggctcattttaaggagaaggttttatcagttttagatttttctactcctggtagaactgctgctgctgtagcttttcttacttttatattggataaatggatccgccaaacccacttcagcaagggatacgttttggatttcatagcagcagctttgtggagaacatggaaggctcgcaggatgaggacaatcttagattactggccagtgcagcctctgggagtagcagggatactgagacacccaccggccatgccagcggttctggaggaggagcagcaggaggacaatccgagagccggcctggaccctccggtggaggagtagctgacttgtttcctgaactgcgacgggtgcttactaggtctacgtccagtggacaggacaggggcattaagagggaaaggaatcctagtgggaataattcaagaaccgagttggctttaagtttaatgagccgtaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacagtatagaattactaagaagattaatattagaaatgcatgctacatatcagggaatggggcagaggttataatagatacacaagataaagcagcttttagatgttgtatgatgggtatgtggccaggggttgtcggcatggaagcagtaacatttatgaatattaggtttaaaggggatgggtataatggcattgtatttatggctaacactaagctgattctacatggttgtagcttttttgggtttaataatacttgtgtagaagcttgggggcaagttagtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcgaatgagaggccttatcagatgctgacctgcgctggtggacattgcaatattctggctaccgtgcatatcgtttcccatgcacgcaagaaatggcctgtatttgaacataatgtgattaccaagtgcaccatgcacataggtggtcgcaggggaatgtttatgccttaccagtgtaacatgaatcatgtgaaggtgatgttggaaccagatgccttttccagagtaagcttaacaggaatctttgatatgaatattcaactatggaagatcctgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagttcggttctagtggtgaagaaactgactaaagtgagtagtgggacgagctgtggaggtgggactttgaggttggtaaggtgggcagattgggtaaattttgttaatttctgtcttgcagctgccatgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattacggaagcatcgttgccaattccagttcctctaataacccttcaaccctggctgaggacaagctacttgttctcttggctcagctcgaggccttaacccaacgcttaggcgaactgtctaagcaggtggcccagttgcgtgagcaaactcagtctgctgttgccacagcaaagtctaaataaagatcttaaatcaataaataaagaaatacttgttataaaaacaaatgaatgtttatttgatttttcgcgcgcggtatgccctggaccatcggtctcgatcattgagaactcggtggatcttttccagtaccctgtaaaggtgggattgaatgtttagatacatgggcattagtccgtcccgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatccggggtgaaattatatgcattttggactggatcttgaggttggcaatgttgccgcctagatcccgtctggggttcatattgtgcagaaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcgaagggtgccagattgggggatgaaagttccctctggcccgggagcatagtttccctcacatatttgcatttcccaggctttcagttcagagggggggatcatatccacctgcggggctataaaaaatactgtttctggagccggggtgattaactgggatgagagcaaattcctaagcagctgagacttgccgcacccagtgggaccgtaaatgaccccaattacgggttgcagatggtagtttagggagcgacagctgccgtcctcccggagcaggggggccacttcgttcatcatttcccttacatggatattttcccgcaccaagtccgttaggaggcgctctcccccaagggatagaagctcctggagcgaggagaagtttttcagcggcttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgggcgtccagcgctgccagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgatcggcgccctgcatgtcggccaggtagcagtttaccatgagttcgtagttgagcgcctcggccgcgtggcctttggcacggagcttacctttggaagttttatggcaggcggggcagtagatacatttgagggcatacagcttgggcgcgaggaaaatggattcgggggagtatgcatccgcaccgcaggaggcgcagacggtttcgcactccacgagccatgtcagatccggctcatcggggtcaaaaacaagttttccgccatgttttttgatgcgtttcttacctttggtttccatgagttcgtgtccccgctgggtaacaaagaggctgtccgtgtccccgtagactgactttatgggcctgtcctcgagcggagtgccgcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagggggcgggcctctgttcgtcttcactgtcttccggatcgctgtccaggagcgccagctgttggggtaggtattccctctcgaaggcgggcatgacctctgcactcaggttgtcagtttctaggaacgaggaggatttgatattgacagtaccagcagagatgcctttcataagactctcgtccatctggtcagaaaacacaatcttcttgttgtccagcttggtggcaaatgatccatagagggcattggatagaagcttggcgatagagcgcatggtttggttcttttccttgtccgcgcgctccttggcggcgatgttaagctggacgtactcgcgcgccacacatttccattcagggaagatggttgtcagttcatccggaactattctgactcgccatcccctattgtgcagggttatcagatccacactggtggctacctcgcctcggaggggctcattggtccagcagagtcgacctccttttcttgaacagaaaggggggagggggtctagcatgaactcatcaggggggtccgcatctatggtaaatattcccggtagcaaatccttgtcaaaatagctgatggtggcgggatcatccaaagtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacagcgcccccctctgatgcttgctcgcacatagtcatagagttcatgtgagggggcgagaagacccgggcccagattggtgcggttgggtttttccgccctgtaaacgatctggcgaaagatggcatgggaattggaagagatagtaggtctctggaatatgttaaaatgggcatgagggaggcctacagagtcccttatgaagtgggcatatgactcttgcagcttggctaccagctcggcggtgacaagtacgtctagggcacagtagtcgagagtttcctggatgatgtcataacgcggttggtttttcttttcccacagctcgcggttgagaaggtattcttcgcgatccttccagtactcttcgaggggaaacccgtctttttctgcacggtaagagcccaacatgtagaattgattgactgccttgtagggacagcatcccttctccactgggagagagtatgcttgggctgcattgcgcagcgaggtatgagtgagggcaaaagtgtccctgaccatgactttgaggaattgatacttgaagtcgatgtcatcacaggccccctgttcccagagttggaagtccacccgcttcttgtaggcggggttgggcaaagcgaaagtaacatcattgaagaggatcttgccggccctgggcataaaatttcgggtgattctgaaaggctgagggacctctgctcggttattgataacctgagcggccaagacgatctcatcaaagccattgatgttgtgccccactatgtacagttctaagaatcgaggtgtgcccctgacatgaggcagcttcttgagttcttcaaaagtgaggtctgtagggtcagtgagagcatagtgttcgagggcccattcgtgcaggtgagggttcgctttgaggaaggaggaccagaggtccactgccagtgctgtttgtaactggtcccggtactgacgaaaatgctgcccgactgccatcttttctggggtgacgcaatagaaggtttgggggtcctgctgccagcgatcccacttgagttttatagccaggtcataggcgatgttgacgagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcatcgattcacgggatgcacctcatgaatgagttgtacctgacttcctttgacgagaaatttcagtggaaaattgaggcctggcgcttgtacctcgcgctctactatgttgtctgcatcggcatgaccatcttctgtctcgatggtggtcatgctgacgagccctcgcgggaggcaagtccagacctcggcgcggcaggggcggagctcgaggacgagagcgcgcaggtcggagctgtccagggtcctgagacgctgcggagtcaggttagtaggcagtgtcaggagattgacttgcatgatcttttcgagggcgtgagggaggttcagatggtacttgatctccacgggtccgttggtggagatgtcgatggcttgcagggttccgtgccccttgggcgctaccaccgtgcccttgtttttccgtttgggcggcggtggctctgttgcttcttgcatgtttagaagcggtgtcgagggcgcgcaccgggcggcaggggcggctcgggacccggcggcatggccggcagtggtacgtcggcgccgcgcgcgggtaggttctggtactgcgccctgagaagacttgcatgcgcgacgacgcggcggttgacatcctggatctgacgcctctgggtgaacgctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgcaaggtcgttggagatgcgtccaatgagttgagagaatgcattcatgcccgcctcgttccagacgcggctgtagaccacagccccctcgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctaacatcgcccagcgcttccaagcgctccatggcctcgtagaagtccacggcaaagttgaaaaactgggagttacgcgcggacacggtcaactcctcttccagaagacggatgagttcggcgatggtggtgcgcacctcgcgctcgaaagcccccgggatttcttcctcaatttcttcttcttccactaacatctcttcctcttcaggtggggctgcaggaggagggggaacgcggcgacgccggcggcgcacaggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctctttggagggtgagacgatgctgctggtgatgaaattaaaataggcagttttgagacggcggatggtggcgaggagcaccaggtctttgggtccggcttgttggatgcgcaggcgatgggccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttctgcgaggatggcttgctgcacctgggtgagggtggcttggaagtcgtcaaagtccacgaagcggtggtaagccccggtgttgattgtgtaggagcagttggccatgactgaccagttgactgtctggtgccccggacgcacaatctcggtgtacttgaggcgcgagtaggcgcgggtgtcaaagatgtaatcgttacaggtgcgcaccaggtactggtagccgatgagaaagtgaggcggcggctggcggtataggggccatcgctctgtagccggggcgccaggggcgaggtcttccagcatgaggcggtgataaccgtagatgtacctggacatccaggtgataccggaggcggtggtggatgcccgcgggaactcgcgtacgcggttccagatgttgcgcagcggcatgaagtagttcatggtaggcacggtttggcccgtgagacgcgcacagtcgttgatgctctagacatacgggcaaaaacgaaagcggtcagcggctcgtctccgtggcctggaggctaagcgaacgggttgggctgcgcgtgtaccccggttcgaatctcggatcaggctggagccgcagctaacgtggtactggcactcccgtctcgacccaggcctgcacaaaacctccaggatacggaggcgggtcgttttttttttgctttttcctggatgggagccagtgctgcgtcaagctttagaacactcagttctcggggctgggagtggctcgcgcccgtagtctggagaatcaatcgccagggttgcgttgcggtgtgccccggttcgagtcttagcgcgccggatcggccggtttccgcgacaagcgagggtttggcagcctcgtcatttctaagaccccgccagccgacttctccagtttacgggagcgagccctcttttttttgttttttgttgcccagatgcatcccgtgctgcgacagatgcgcccccagcaacagcccccttctcagcagcagctacaacaacagccacaaaaggctcttcctgctcctgtaactactgcggctgcagccgtcagcggcgcgggacagcccgcctatgatctggacttggaagagggcgagggattggcgcgcctgggggctccatcgcccgagcggcacccgcgggtgcaactaaaaaaggactctcgcgaggcgtacgtgccccaacagaacctattcagggacaggagcggcgaggagccagaggagatgcgagcatctcgatttaacgcgggtcgcgagctgcgccacggtctggatcgaagacgggtgctgcaagacgaggattttgaggtcgatgaagtgacagggatcagcccagctagggcacatgtggccgcggccaacctagtctcggcctacgagcagaccgtgaaggaggagcgcaacttccaaaaatcttttaacaaccatgtgcgcaccctgatcgcccgcgaggaagtgaccctgggtctgatgcacctgtgggacctgatggaggctatcacccagaaccccactagcaaacccctgacagctcagctgtttctggtggttcaacatagcagggacaacgaggcattcagggaggcgttgttgaatatcaccgagcctgatgggagatggctgtatgatctgattaacatcctgcaaagtattatagtgcaggaacgtagcctgggtttggctgagaaagtggcagctatcaactactcggtcttgagcctgggcaaatactacgctcgcaagatctacaagaccccctacgtacccattgacaaggaggtgaagatagatgggttttacatgcgcatgactctcaaggtgttgactttaagcgacgatctgggggtgtatcgcaatgacaggatgcaccgcgcggtgagcgccagcaggaggcgcgagctgagcgacagagaacttatgcacagcttgcaaagggctctaacgggggccggaactgatggggagaactactttgacatgggagcggacttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacaacagcaggcaccggaccccgcaatgcgggcggcgctacagagccagccgtccggcattaactcctcggacgattggacccaggccatgcaacgtataatggcgctgacgacccgcaaccccgaagcctttagacagcaaccccaggccaaccgcctttcggccatactggaggccgtagtgccctcccgctccaaccccacccacgagaaggtcctggctatcgtgaacgcgctggtggagaacaaggccatccgtcccgatgaggccgggctggtatacaatgctcttttggagcgcgtggcccgttacaacagcagcaacgtgcagaccaacctggaccggatggtgaccgatgtgcgcgaggctgtgtctcagcgcgagcggttccagcgcgacgccaacttggggtcattggtagcgctaaacgctttccttagcacccagcccgccaacgtgccccgtggtcagcaagactatacaaactttttgagtgcattgagactcatggtatctgaggtgccccagagcgaggtgtaccagtccgggccagattacttcttccagaccagcagacagggcttgcagacagtgaacctgacccaggctttcaagaacctgaagggtctgtggggagtgcacgccccagtaggagatcgcgcgaccgtgtctagcttgctgactcccaactcccgcctgctgctgctgctggtatcccccttcactgacagcggtagcatcgaccgcaactcctacttgggctacctgcttaacctgtatcgcgaggctataggacagagccaggtggacgagcagacctatcaagaaatcacccaagtgagccgcgccctgggtcaggaagacacaggcggtttggaagccaccctgaacttcttactaaccaaccggtcgcagaagatccctcctcagtatgcgcttaccgctgaggaggagcggatcctaagatacgtgcaacagagcgttggactgtttttgatgcaggagggggcgacacctaccgccgcgctggatatgacagctcgaaacatggagcccagcatgtatgctagtaacaggcctttcattaacaaactgctggactacctgcacagggcggccgccatgaactctgattatttcaccaatgctattctgaacccacactggctgcccccacctggtttctacactggcgaatacgacatgcccgatcccaatgacgggttcctatgggacgatgtggacagtagcatattttccccgccgccaggttatacggtttggaagaaggaagggggcgatagaaggcactcttccgtatcgttgcccggaacggctggtgctgccgcggccgtgcccgaagctgcgagtcctttccctagcttgtccttttcactaaacagcgttcgcagcagtgaactggggagaataaaccgcccgcgcttgatgggcgaggatgagtacttgaatgactctttgctgaggccagagagggaaaagaacttccctaacaatggaatagagagcctggtggataagatgagtagatggaagacctatgcgcaggatcacagagacgagcccaggatcttgggggctacaagcagaccgagccgtagacgccagcgccacgacaggcagatgggtcttgtgtgggacgacgaggactctgccgatgacagcagcgtgttggacttgggtggaaaaggagttggcaacccgttcgctcatctgcgtccccgtttcggtcgcatgttgtaaaagtgaaagtaaaaataaaaaggcaactcaccaaggccatggcaaccgagcgtgcgttcgttcttttttttgttatctgtatctagtacgatgaggagacgagccgtgctaggcggagcggtggtgtatccggagggtcctcctccttcttacgagagcgtgatgcagcaacaggcggcgatgatacagcccccactggaggctcccttcgtaccccctcggtacctggcgcctacggaagggagaaatagcattcgttactcggagctgtcaccccagtacgataccaccaagttgtatctggcggacaacaagtcggcggacatcgcctccctgaactatcagaacgaccacagcaacttcctgaccacagtggtgcagaacaatgactttacccccacggaggctagcacccagaccattaactttgacgagcggtcgcggtggggcggtcagctgaagaccattatgcacaccaacatgcccaacgtgaacgagtacatgttcagcaacaagtttaaggcgagggtgatggtatctaggaaggctcctgaaggtgttacagtaaatgatcataaagatgatattttgaaatatgagtggtttgagttcactttaccagaaggtaacttctcagctaccatgaccatcgacctgatgaacaatgccatcattgacaactacctgaaaattggcagacagaatggagtgctggaaagtgacattggtgttaagtttgacactagaaacttcaggctcgggtgggaccccgaaactaagttgattatgccaggggtctacacttatgaggcattccatcctgacattgttttgttgcctggttgcggggtagattttactgaaagccgacttagcaacttgcttggcatcaggaagagacatccattccaggagggtttcaaaatcatgtatgaagatcttgaagggggtaatattcctgcccttttggatgtcactgcctatgaggaaagcaaaaaggataccactactgaaacaggcgaaaaggcggtggttaaaacaaccacagtggctgttgcagaggaaaccagtgaagatgataatataactagaggagatacttatataactgaaaaacaaaaacgtgaagctgcagctgcagaactattacttatgtctgaagttaaaaaagagttaaagatccaacctttagaaaaagacagcaagaatagaagctacaatgtcttggaagacaaaatcaacacagcctaccgcagctggtacctgtcctacaattatggtaaccctgagaaaggaataaggtcctggacactgctcaccacttcggatgtcacctgtggagccgagcaggtctactggtcgctccccgacatgatgcaagaccccatcaccttccgctcctcgagacaagtcaacaactacccagtagtgggtgcagagcttatgccggtcttctcaaagagtttctacaatgagcaagccgtgtactctcagcagctccgacagtccacctcgctcacgcacgtcttcaaccgcttccctgagaaccagatcctcatccgcccgccggcgcccacaattaccaccatcagtgaaaacgttcctgctctcacagatcacgggaccctgccgttacgcagcagtatccggggagtccagcgcgtgaccgttactgacgccagacgtcgcacctgtccctacgtttacaaggccctgggcatagtcgcgccgcgcgttctttcaagccgcactttctaaaaaaaaaaaaaaatgtccattctcatctcgcccagtaataataccggttggggactgcatgcgcccaccaagatgtacggaggcgcccgcaaacgctctacccagcaccccgtgcgcgttcgcggtcatttccgcgctccctggggcgccctcaagggccgtacccgcactcggaccacggtcgatgatgtgatcgaccaggtggttgccgatgctcgtaattatactcctactgcgcctacatctactgtggatgcagttattgacagtgtagtggcagacgctcgcgcctatgctcgccggaagagccgaaggaggcgcatcgccaggcgccacagggctactcccgctatgcgagctgcaaaagctattctgcggagggccaaacgtgtgggacgaagagccatgcttagagcggccagacgcgcggcttctggtgctagcagcggcaggtcccgcaggcgcgcggccacggcggcagcagcggccattgccaacatggcccaaccgcgaagaggcaatgtgtattgggtgcgcgatgccactaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccgccgatgaaggatgaaaaaaagccccgcaaaatcaagcgggttaaaaaggacaaaaaagaagaagatggcgatgatggactggtggagtttgtgcgcgagttcgcgccaagacggcgcgtgcagtggcgcggtcgaaaagtacgccaagtgcttagacccgggaccactgtggtctttacacctggcgagcgttccagcactacttttaaacggtcctatgatgaggtgtatggggatgacgatattattgagcaggcggcagaccgccttggcgagtttgcttatggcaagcgcacaagatccagtcccaaagaggaggcggtatctattcccttggatcatggaaatcccacccctagcctcaaaccagtcaccctgcagcaagtgctgcccgtacctgcgagcagaggcgtaaagcgcgagggtgaggacctatatcccaccatgcagctaatggtgcccaagcggcagagattagaagacgtactggagaaaatgaaagtggatgccgatatccagcctgaggtgaaagtgagacccatcaaggaagtggcgccaggtttgggagtacaaacctttgacatcaagattcccactgagtccatggaagtgcagaccgaacctgcaaaacccacagtcacctcaattgaggttcagacggaaccctggatgcccgcgcccgttgccgcccccagcaccactagaagatcacgtcgaaagtatggcccagcaagtctgctaatgcccaactatgctctgcacccatccatcattcccactccgggttacagaggcactcgctactatcgaagtcggagcaacacctcacgccgccgcaaactacctgcaagtcgcactcgccgtcgccgccgccgcaccactgccagcaaattaactcccgccgccctggtgcggagagtgtaccgcgatggtcgcgctgaacctctgacgctgccgcgcgcgcgctatcatccaagcatcaccacttaatgactgttgacgctgcctccttgcagatatggctctcacttgccgccttcgcgtccccattactggctaccgaggaagaaactcgcgccgtagaaggatgttggggcgagggatgcgccgccacagacgaaggcgcgctatcagcaagcgattagggggtggctttctgccagctcttatacccatcatcgccgcggcgatcggggcgataccaggcatagcttccgtggcggttcaggcctcgcagcgccactaacaatggaaaaatttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccataaaaacctatgggaacaaagcttggaacagcagcacagggcaggcccttagaaataagcttaaggagcagaacttccaacaaaaggtggtcgatggtatcgcctctggtattaacggcgtagtggatctagccaaccaggctgtgcagaaacagataaacagccgcctggacccgccgcccgcaactcctggtgaaatggaagtggaggaagagcttcctccgctggagaagcggggcgacaagcgaccgcgtcccgagctggaacagacgttggtgacgcgcgcagacgagcccccttcatacgaggaggcagtaaagctcggaatgcccactaccaggcctgtagctcacatggctaccggggtgatgaaaccttctcagtcgcatcggcctgccaccttggacttgcctcctccccctgcttctgcggcgcctattcccaaacctgtcgctaccagaaagcccaccgccgtacagcccgtcgccgtagccagaccgcgtcctgggggcacaccgcgcccgaaagcaaactggcagagtactctgaacagcatcgtgggtctgggcgtgcagagtgtaaagcgccgtcgctgctattaattaaatatggagtagcgcttaacttgcttgtctgtgtgtatgtatcatcaccatgccgccgcagcagaggagaaaggaagaggtcgcgcgccgaggctgagttgctttcaagatggccaccccatcgatgatgccccaatgggcatacatgcacatcgccggacaggatgcttcggagtacctgagtccgggtctggtgcagttcgcccgtgcaacagacacctacttcagtatggggaacaagtttagaaaccccacagtggcgcccacccacgatgtgaccaccgaccgtagccagcgactaatgctgcgcttcgtgcccgttgaccgggaagacaatacctactcttacaaagttcgctacacgctggctgtaggggacaacagagtactggatatggccagcacgttctttgacatccgcggcgtgctggaccggggccctagcttcaaaccctactccgggaccgcctacaacagcctggctcccaagggagcgcccaacacctgccagtggaaggattctgacagcaaaatgcatacctttggggtagctgccatgcccggtgttactgggaaaaagatagaagctgatgggctgcctattggaatagattcaacttctggaactgacacagtaatttatgctgataaaactttccaaccagaaccacaagttggaaatgccagttgggttgacgccaatggtacagaggaaaaatatggaggcagagctctgaaggacactacaaagatgaaaccctgctatggttctttcgccaagcctaccaacaaagaaggtggtcaggctaacttaaaagattcagaaaccgccgccaccactcctaactatgatatagatctggctttctttgacaacaaaaatattgctgctaactacgatccagatattgtaatgtacacagaaaatgttgacttgcagactccagatactcatattgtatacaaacctggaacagaggacaccagctctgaatccaatttgggtcagcaagccatgcctaacagacccaactacattggcttcagagacaattttattgggctcatgtactacaacagcactggcaatatgggggtgctggccggtcaggcctctcagctgaatgctgtggttgacttgcaagacagaaacactgaactgtcctaccagctcttgcttgactctctgggtgacagaacccggtatttcagtatgtggaatcaggcggtggacagctatgatcctgatgtgcgtattattgaaaaccatggtgtggaggacgaattgccaaactattgctttccgttgaatggtgtgggatttacagacacttaccaaggtgttaaagttaaaacagatgcagttgctggaaccagtggaacacagtgggacaaagatgacaccacagttagtactgctaatgaaatccatggaggcaatccttttgccatggaaatcaacatccaagccaatctatggcgaagtttcctttattccaatgtggctttgtatctcccagactcgtataaatacaccccgtccaatgtcactctcccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtaaacatggttctacagagttcccttggtaacgacctacgggtagatggcgccagcatcagtttcacgagcatcaatctttatgctacttttttccccatggctcacaacaccgcttccacccttgaagccatgctgcggaatgacaccaatgatcagtcattcaacgactacctatctgcagctaacatgctctaccccatacctgccaacgcaaccaatattcccatttccattccttctcgcaactgggcggctttcagaggctggtcatttaccagactgaaaaccaaagaaactccctctttggggtctggatttgacccatactttgtctattccggttctattccctacctggatggtaccttctatctaaatcacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacattggctaccagggcttttacatccctgagggatacaaggatcgcatgtactcctttttcagaaacttccagcctatgagcaggcaggtggttgatgaggttaattacactgactacaaagccgtcaccttaccatatcaacacaacaactctggctttgtaggataccttgcgcctactatgagacaaggggaaccttacccagccaattatccatacccgctcatcggaactactgccgttaagagtgttacccaaaaaaagttcctgtgcgacaggaccatgtggcgcataccgttctccagcaacttcatgtccatgggggcccttacagacctgggacaaaacctgctctatgccaactcggcccatgcactggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgtcatgcgggtccggaaacggctccagcgagcaagagctcaaagccatcgtccgagacctgggttgcggtccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccacgctcagccgcctgtggacttttttgctgtatgttccttcatgcctttgtgcactggcccgaccgtcccatgaacggaaaccccaccatgaagttgctgactggggtgcccaacagcatgctccaatctccccaagtccagcccaccctgcgccgcaaccaggaggcactataccgcttcctaaacacccactcatcttactttcgttctcaccgcgcacgcatcgaaagggccaccgcgtttgaccgtatggatatgcaataagtcatgtaaaaccgtgttcaataaaaagcactttatttttacatgcactaaggctctggttttttgctcattcgttttcatcattcactcagaaatcaaatgggttctggcgggagtcatagtggcccgcgggcagggatacgttgcggaactgtaacctgttctgccacttgaactcggggatcaccagcttgggaactggaatctcgggaaaggtgtcttgccacaactttctggtcagttgcagggcgccaagcaggtcaggagcagagatcttgaaatcacagttggggccggcattctggacacgggagttgcggtacactgggttgcaacactggaacaccatcaaggctgggtgtctcacgcttgccagcacggtcgggtcactgatggtagtcacatccaagtcttcagcattggccatcccaaagggggtcatcttacaggtctgcctgcccatcacgggagcgcagcctggcttgtggttgcaatcgcaatgaatgggaatcagcatcatcctggcttggtcgggggttatccctggatatacggccttcatgaaggcttcgtactgcttgaaagcttcctgagccttacttccctcggtgtagaacattccacaggacttgctggaaaattggttagtagcacagttggcatcatttacacagcagcgggcatcgttgttggccaactgaaccacatttctgccccagcggttctgggtgatcttggctctgtctgggttctccttcatagcgcgctgcccgttctcgctcgccacatccatctcgataatgtggtccttctggatcatgatagtgccatgcaggcatttcaccttgccttcgtaatcggtgcatccatgagcccacagagcgcacccggtgcactcccaattattgtgggcgatctcagaataagaatgcaccaatccctgcatgaatcttcccatcatcgctgtcagggtcttcatgctactaaatgtcagcggaatgccacggtgctcctcgttcacatactggtggcagatacgcttgtactgctcgtgctgctctggcatcagcttgaaagaggttctcaggtcattatccagcctatacctctccattagcacagccatcacttccatgcccttctcccaggcagataccaggggcaagctcaaaggattcctaacagcaatagaagtagctcctttagctatagggtcattcttgtcgatcttctcaacacttctcttgccatccttctcaatgatgcgcaccggggggtagctgaagcccacggccaccaactgagcctgttctctttcttcttcgctgtcctggctgatgtcttgcagagggacatgcttggtcttcctgggcttcttcttgggagggatcgggggaggactgttgctccgttccggagacagggatgaccgcgaagtttcgcttaccagtaccacctggctctcgatagaagaatcggaccccacgcgacggtaggtgttcctcttcgggggcagaggtggaggcgactgagatgggctgcggtctggccttggaggcggatggctggcagagcccattccgcgttcgggggtgtgctcccgttggcggtcgcttgactgatttcctccgcggctggccattgtgttctcctaggcagagaaacaacagacatggaaactcagccatcactgccaacatcgctgcaagcgccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaagcagatggcgatcaccaggaggctggcctcggggatcatgttgccgactacctctccgggcgtgggggggaggacgtgctcctcaaacatctagcaaggcagtcgctcatagttaaagacgcactactcaacctcaccgaagtgcccatcagtgtggaagagcttagccgcgcctacgagctgaacctcttttcgcctcagataccccccaagcggcagccaaacggcacctgcgaggccaaccctcgactcaacttctatccagcttttactgtccccgaagtgctggccacctaccacatcttttttaagaaccaaaagattccagtctcctgccgcgccaaccgcacccgcgcagatgcccttctcaacttgggtccgggagctcgcttacctgatatagcttccttggaagaggttccaaagatctttgagggtctgggaagtgatgagactcgggccgcaaatgctctgcaacagggagagaatggcatggatgaacatcacagcgctctagtggaactggagggtgacaatgcccggcttgcagtgctcaagcgcagtatcgtggtcacccattttgcctaccccgctgttaacctgccgcccaaagtcatgagcgctgtcatggaccatctgctcatcaaacgagcaagtccactttcagaaaaccagaacatgcaggatccagacgcctcggacgagggcaagccggtagtcagtgacgagcagctatctcgctggctgggtaccaactccccccgagatttggaagaaagacgcaagcttatgatggctgtagtgctagtaactgttgagttggagtgtctgcgccgcttttttaccgaccccgagaccctgcgcaagctagaggagaacctgcactacaccttcagacatggcttcgtgcggcaggcatgcaagatctccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaaccttaaagagctggacaagctcttgcagagatccctcaaagccctgtggacaggttttgacgagcgcaccgtcgcctcggacttggcggacatcatcttccccgagcgtcttagggttactctgcgaaacggcctgccagacttcatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctattccgcctggccaactacctctcctaccactcggatgtgatagaggatgtgagcggagacggcctgctggaatgccactgccgatgcaatttatgcacaccccaccgctccctcgcctgcaacccccagttgctaagcgagacccagatcatcggcaccttcgagttgcagggtcccaacagtgaaggcgaggggtcttctccggggcagagtctgaaactgacaccggggctgtggacctccgcctacctgcgcaagtttcatcccgaggactatcatccctatgagatcaggttctatgaggaccagtcacatcctcccaaagtcgagctctcagcctgcgtcatcacccagggggcaattctggcccaattgcaagccatccaaaaatcccgccaagaatttctgctgaaaaagggaagcggggtctaccttgacccccagaccggtgaggagctcaacacaaggttcccccaggatgtcccatcgccgaggaagcaagaagctgaaggtgcagctgtcacccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgattcccaaacccgaccaccgcttccaagaccggtaagaaggagcgacagggatacaagtcctggcgtggacataaaaacgctatcatctcctgcttgcatgaatgcgggggcaacatatccttcacccggcgatacctgcttttccaccacggtgtgaacttcccccgcaatatcttgcattactaccgtcacctccacagcccctactgcagtcagcaagtcccggcaaccccgacagaaaaagacagcagcgacaacggtgaccagaaaaccagcagttagaaaatccacaacaagtgcagcaggaggaggactgaggatcacagcgaacgagccagcgcagaccagagagctgaggaaccggatctttccaaccctctatgccatcttccagcagagtcgggggcaagagcaggaattaaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgctcattcgaaaacggcgggaatcacgtcacccttggcagctgtcctttgccctcgtcatgagtaaagagattcccacgccttacatgtggagctatcagccccaaatggggttggcagcaggtgcttcccaggactactccacccgcatgaattggcttagcgccgggccctcaatgatatcacgggttaatgatatacgagcttatcgaaaccagttactcctagaacagtcagctctcaccaccacaccccgccaacaccttaatccccgaaattggcccgccgccctggtgtaccaggaaaatcccgctcccaccaccgtactacttcctcgagacgcccaggccgaagttcagatgactaacgcaggtgtacagctggcgggcggttccgccctatgtcgtcaccgacctcaacagagtataaaacgcctggtgatcagaggccgaggtatccagctcaacgacgagtcggttagctcttcgcttggtctgcgaccagacggagtcttccagatcgccggctgtgggagatcttccttcactcctcgtcaggctgtgctgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattgatgtctaatggtggcgcggctgagctagctcgactgcgacacctagaccactgccgccgctttcgctgtttcgcccgggaactcaccgagttcatctacttcgaactctccgaggagcaccctcagggtccggcccacggagtgcggattaccatcgaagggggaatagactctcgcctgcatcgcatcttctcccagcggcccgtgctgattgagcgcgaccagggaaatacaaccatctccatctactgcatttgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctctgatccaggactctaactctaccttaccagcaccctccactactaaccttcccgaaactaacaagcttggatctcatctgcaacaccgcctttcacgaagccttctttctgccaatactaccactcccaaaaccggaggtgagctccgcggtcttcctactgacgacccctgggtggtagcgggttttgtaacgttaggagtagttgcgggtgggcttgtgctaatcctttgctacctatacacaccttgctgtgcatatttagtcatattgtgctgttggtttaagaaatgggggccatactagtcgtgcttgctttactttcgcttttgggtctgggctctgctaatctcaatcctcttgatcacgatccatgtctagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttcccgagtggtatactgtctctgtccgaggtcctgacggttccattcgcattagtaacaacactttcattttttctgaaatgtgcgatctggccatgtttatgagcaaacagtatgacctatggcctcctagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactaaaccaatatttgtaatctgcaacagacaaaatctcacgttaattaatgtcagcaaaatttataacggttactattatggttatgatagatccagtagtcaatataaaaattacttagttcgcataactcaacccaaatcaacagtgccaactatgacaataattaaaatggctaataaagcattagaaaattttacattaccaacaacgcccaatgaaaaaaacattccaaattcaatgattgcaattattgcggcggtggcattgggaatggcactaataataatatgcatgttcctatatgcttgttgctataaaaagtttaaacataaacaggatccactactaaattttaacatttaattttttatacagatgatttccactacaatttttatcattactagccttgcagctgtaacttatggccgttcacacctaactgtacctgttggctcaacatgtacactacaaggaccccaagaaggccatgtcacttggtggagaatatatgataatggagggttcgctagaccatgtgatcagcctggtacaaaattttcatgcaacggaagagacttgaccattattaacataacattaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttcgaaaaatcgctttaagtaattccacagccgctcccaatacaattcctaaatcaacaattggcatcattactgccgtggtagtgggattaataattatatttttgtgcataatgtactacgcctgctgctatagaaaacatgaacaaaaaggtgatgcattactaaattttgatatttaattttttatagaattatgatattgtttcaatcaaataccactaacactatcaatgtgcagactactttaaatcatgacatggaaaaccacactacctcctatgcatacacaaacattcagcctaaatacgctatgcaactagaaatcaccatactaattgtaattggaattcttatactatctgttattctttattttatattctgccgtcaaatacccaatgttcatagaaattctaaaagacgacccatctattctcctatgattagtcgtccccatatggctctgaatgaaatctaagatctttttttttctcttacagtatggtgaacatcaatcatgattcctagaaatttcttcttcaccatactcatctgtgctttcaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtgcgaattgcctacctacgtcaccatcccgaataccgcaatcaaaatgttgcggcactttttaggcttatttaaaaccatgcaggctatgctgccagtcattttaattctgctcctaccctgcattgccctagcttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagaaccacatgaacatatcccactacaacacatacaacaaccactagcactggtagagtatgaaaatgagccacaaccttcactgcctcctgccattagttacttcaacctaaccggcggagatgactgaaatactcaccacctccaattccgccgaggatctgcttgatatggacggccgcgcctcagaacagcgactcgcccaactacgcatacgccagcagcaggaacgtgccgccaaggagctcagggatgctattgaaattcaccaatgcaaaaaaggcatattttgtttggtaaaacaagccaagatatcctacgagattaccaatactgaccatcgcctctcatacgagctcggaccgcagcgacaaaaattcacttgtatggtgggaatcaaccccataatcatcacccagcaagctggagataccaagggttgcatccactgttcctgcagttccgccgagtgcatctacaccctgctgaagaccctctgcggccttcgagacctcctacccatgaactaatcaacccagcccctcacttaccaattacataaagccaattaataaaaacacttacttgaaatcagaaataaggtttctgtctacgttgtttccaagcagcacctcacttccttcttcccaactctggtactctaagcctcggcgggtggcatacttcctccacactttgaaagggatgtcaaattttagttcctcttctttgcccacaatcttcatttctttatccccagatggccaaacgagctcggctaagcagctccttcaatccggtctacccctatgaagatgaaagcagctcacaacacccctttataaaccctggtttcatttcctcaaatggttttgcacaaagcccagatggagttctaactcttaaatgtgttaatccactcactaccgccagcggacccctccaacttaaagttggaagcagtcttacagtagatactatcgatgggtctttggaggaaaatataactgccgcagcgccactcactaaaactaaccactccataggtttattaataggatctggcttgcaaacaaaggatgataaactttgtttatcgctgggagatgggttggtaacaaaggatgataaactatgtttatcgctgggagatgggttaataacaaaaaatgatgtactatgtgccaaactaggacatggccttgtgtttgactcttccaatgctatcaccatagaaaacaacaccttgtggacaggcgcaaaaccaagcgccaactgtgtaattaaagagggagaagattccccagactgtaagctcactttagttctagtgaagaatggaggactgataaatggatacataacattaatgggagcctcagaatatactaacaccttgtttaaaaacaatcaagttacaatcgatgtaaacctcgcatttgataatactggccaaattattacttacctatcatcccttaaaagtaacctgaactttaaagacaaccaaaacatggctactggaaccataaccagtgccaaaggcttcatgcccagcaccaccgcctatccatttataacatacgccactgagaccctaaatgaagattacatttatggagagtgttactacaaatctaccaatggaactctctttccactaaaagttactgtcacactaaacagacgtatgttagcttctggaatggcctatgctatgaatttttcatggtctctaaatgcagaggaagccccggaaactaccgaagtcactctcattacctcccccttctttttttcttatatcagagaagatgactgacaacaaaaaaaataaagatcaacttttttattgaaaatcagtttacaagattcgagtagttattttgcccccctcttcccattttatagaatacacaattctctccccacgcacagctttgaacatttgaattccattagagatagacatagttttagattccacattccacacagtttcagagcgggccaatcttggatcagtgatagatataaatccatcggaacagtctttcaaggtggtttcacagtccaactgctgcggctgcggctccggggtttggattagggtcatctggaagaagaacgatgggagtcataatccgagaacgggatcgggcggttgtgtcttaaacctcgaagcaatcgctgtctgcgccgctccgtgcgactgctgctgatgggatcaggatccacagtctctcgaagcataattttaatagccctcaacattaacatcctggtgcgatgggcacaacaacgcattctaatttcgcttagctcactgcagtaggtacaacacattaccacaatgttgtttaacaggccataattaaaggtgctccagccaaaactcatctcagggataatcatacccgcgtgaccatcgtaccaaatcttaatgtaaattagatgacgccccctccagaacacactgcccacatacataatttccttgggcatatgcatgttcacaatttctctgtaccatggacagcgctggttaatcatacagcccctaataaccttccggaaccacatagctagcactgctcccccagcaatacattgaagagaacccggctgtttacagtgacaatggagaacccacttctctcgcccatggatcacttgagaattaaatatatctatagtggcacaacacaaacataaatgcatgcatcttttcataaccctcaactcttcgggggttaaaaacatatcccagggaataggaagctcttgcaaaacagtaaagctggcagaacaaggaagaccacgaacacaacttacactatgcatagtcatagtatcacaatctggcaacagcgggtggtcttcagtcatagaagctcgggtttcattttcctcacatcgtggtaactgggctctggtgtaagggtgatgtctggcgcatgatgtcgagcgtgcgcgcaaccttgtcataatggagttgcttcctgacattctcgtattttgtatagcaaaatgcggccctggcacaacacacttttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgcgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttgaattattcgtgtcagttcttgtggtaaatccaaaccacacattacaaacaggtcccggagggcgccctccaccaccattcttaaacacaccctcataatgacaaaatatcttgctcctgtgtcacctgtagcaaattaagaatggcatcatcaattgacatgcccttggctctaagttcttctctaagttctagttgtaaatactctctcatattatcaccaaactgcttagccagaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaagaaacattcaaaacctctgggatgcaaatgcaataggttaccgcgctgcgctccaacattgttagttttgaattagtctgtaaaataaaagaaacaagcgtcatatcatagtagcctgtcgaacaggtggataaatcagtctttccatcacaagacaagccacagggtctccagcttgaccctcgtaaaacctgtcatcgtgattaaacaacagcaccgaaagttcctcgcggtggccagcatgaataattcttgatgaagcatataatccagacatgttagcatcagttaaagagaaaaaacagccaacatagcctctgggtataattatgcttaatcttaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcgcacaaagcacaagctctaaagaagctctaaagacactctccaacctctccacaatatatacacaagccctaaactgacgtaatgggagtaaagtgtaaaaaatcccgccaagcccaacacacaccccgaaactgcgtcagcagggaaaagtacagtttcacttccgcaaacccaacaagcgtaacttcctctttctcacggtacgtcacatccgattaacttgcaacgtcattttcccacggccgcaccgccccttttagccgttcaccccgcagccaatcaccacacagcgcgcacttttttaaattacctcatttacatgttggcaccattccatctataaggtatattatagataatggcgatcgc

SEQ ID NO: 7 - DNA, 35590 bp, Adenovirus B21
  MISC_FEATURE (1)..(35590): Complete Genome
ctgcaggttaattaaggaagggcgaattctgcagatatccatcacactggcggccgctcgagcatgcatctagagggcccaattcgccctatagtgagtcgtattacaattcactggcctattatataatataccttatagatggaatggtgccaatatgcaaatgaggtaatttaaaaaagtgcgcgctgtgtggtgattggctgcggggttaacggctaaaaggggcgggcaatgctgggaggtgacgtaacttatgtaggaggagttatgttgcaagttatcgcggtaaaggtgacgtaaaacgaggtgtggtttggacacggaagtagacagttttcccacgcttactgacaggatatgaggtagttttgggcggatgcaagtgaaaattctccattttcgcgcgaaaactgaatgaggaagtgaatttctgagtcatttcgcggttatgacagggtggagtatttgccgagggccgagtagactttgaccgtttacgtggaggtttcgattaccgtgtttttcacctaaatttccgcgtacggtgtcaaagtcctgtgtttttacgtaggtgtcagctgatcactagggtatttaaacctgtcgagttccgtcaagaggccactcttgagtgccagcgagaagagttttctcctccgcgctgcgagtcagttttgcgctttgaaaatgagacacctgcgattcctgccacaggagattatctccagcgagaccgggatcgaaatactggagtttgtggtaaataccctgatgggagatgacccggaaccgccagtgcagcctttcgatccacctacgctgcacgatctgtatgatttagaggtagacgggcctgatgatcccaatgaggaagctgtaaatgggttttttactgattctatgctgctagctgccgatgaaggattggacataaaccctcctcctgggacccttgataccccaggggtggttgtggaaagcggcagaggtgggaaaaaattgcctgatctgggagcagctgaaatggacttgcgttgttatgaagagggttttcctccgagtgatgatgaagatggggaaactgaacagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctgtttaataactgttgaatggtagatttatgtttttacttgcgattttttgtaggtcctgtgtctgatgatgaggcgccttctcctgattcaactacctcacctcctgaaattcaggcgcccgtacctgcaaacgtatgcaagcccattcctgtgaagcctaagtgtgggaaacgccctgctgtggataagcttgaggacttgttggagggtggggatggacctttggaccttagtacccggaaactgccaagacaatgagtgccctgcagctgtgtttatttaatgtgacgtcatgtaataaaattatgtcagctgctgagtgttttattgcttcttgggtggggacttggatatataagtaggagcagatctgtgtggttagctcatagcaacctgctgccatccatggaggtttgggctatcttggaagacctgagacagactaggctactgctagaaaacgcctcggacggagtctctggcttttggagattctggttcggtggtgatctagctaggctagtgtttaggataaaacaggactacagggaagaatttgaaaagttattggacgacagtccaggactttttgaagctcttaacttgggccaccaggctcattttaaggagaaggttttatcagttttagatttttctactcctggtagaactgctgctgctgtagcttttcttacttttatattggataaatggatccgccaaacccacttcagcaagggatacgttttggatttcatagcagcagctttgtggagaacatggaaggctcgcaggatgaggacaatcttagattactggccagtgcagcctctgggagtagcagggatactgagacacccaccggccatgccagcggttctggaggaggagcagcaggaggacaatccgagagccggcctggaccctccggtggaggagtagctgacctgtttcctgaactgcgacgggtgcttactaggtctacgtccagtggacaggacaggggcattaagagggagaggaatcctagtgggaataattcaagaaccgagttggctttaagtttaatgagccgtaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacagtatagaattactaagaagattaatattagaaatgcatgctacatatcagggaatggggcagaggttataatagatacccaagataaagcagcttttagatgttgtatgatgggtatgtggccaggggttgtcggcatggaagcagtaacatttatgaatattaggtttaaaggggatgggtataatggcattgtatttatggctaacactaagctgattctacatggttgtagcttttttgggtttaataatacttgtgtagaagcttgggggcaagttggtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcgaatgagaggccttatcagatgctgacctgcgctggtggacattgcaatattcttgctaccgtgcatatcgtttcccatgcacgcaagaaatggcctgtatttgaacataatgtgattaccaagtgcaccatgcacataggtggtcgcaggggaatgtttatgccttaccagtgtaacatgaatcatgtgaaggtgatgttggaaccagatgccttttccagagtgagcttaacaggaatctttgatatgaatattcaactatggaagatcctgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagttcggttctagtggtgaagaaactgactaaagtgagtagtggggcaatatgtggatggggactttcaggttggtaaggtggacagattgggtaaattttgttaatttctgtcttgcagctgccatgagtggaagcgcttcttttgaggggggagtatttagcccttatctgacgggcaggctcccatcatgggcaggagttcgtcagaatgtcatgggatccactgtggatgggagacccgtccagcccgccaattcctcaacgctgacctatgccactttgagttcgtcatcattggatgcagctgcagccgccgccgctactgctgccgccaacaccatccttggaatgggctattacggaagcatcgttgccaattccagttcctctaataacccttcaaccctggctgaggacaagctgcttgttctcttggctcagctcgaggccttaacccaacgcttaggcgaactgtctaagcaggtggcccagttgcgtgagcaaactgagtctgctgttgccacagcaaagtctaaataaagatctcaaatcaataaataaagaaatacttgttataaaaacaaatgaatgtttatttgatttttcgcgcgcggtatgccctggaccatcggtctcgatcattgagaactcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatcctgggtgaaattatatgcattttggactggatcttgaggttggcaatgttgccgcctagatcccgtctcggattcatattgtgcagaaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctctggcccgggagcatagtttccctcacatatttgcatttcccaggctttcagttccgagggggggatcatgtccacctgcggggctataaaaaataccgtttctggagccggggtgattaactgggatgagagcaaattcctaagcagctgagacttgccgcacccagtgggaccgtaaatgaccccaattacgggttgcagatggtagtttagggagcgacagctgccgtcctcccggagcaggggggccacttcgttcatcatttcccttacatggatattttcccgcaccaagtccgttaggaggcgctctcccccaagggatagaagctcctggagcgaggagaagtttttcagcggcttcagcccgtcagccatgggcattttggaaagagtctgttgcaagagctcgagccggtcccagagctcggtgatgtgctctatggcatctcgatccaacagacctcctcgtttcgcgggttgggacggctcctggagtagggaatcagacgatgggcgtccagcgctgctagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgatcggcgccctgcaggtcggccaggtagcagtttaccatgagttcgtagttgagcgcctcggccgcgtggcctttggcacggagcttacctttggaagttttatggcaggcggggcagtagatacatttgagggcatacagcttgggcgcgaggaaaatggattcgggggagtatgcatccgcaccgcaggaggcgcagacggtttcgcactccacgagccaggtcagatccggctcatcggggtcaaaaacaagttttccgccatgttttttgatgcgtttcttacctttggtttccatgagttcgtgtccccgctgggtgacaaagaggctgtccgtgtccccgtagaccgactttatgggcctgtcctcgagcggagtgcctcggtcctcttcgtagaggaacccagcccactctgatacaaaagcgcgtgtccaggccagcacaaaggaggccacgtgggaggggtagcggtcgttgtcaaccagtgggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttcaggatcgctgtccaggagcgccagctgttggggtaggtattccctctcgaaggcgggcatgacctctgcactcaggttgtcagtttctaggaacgaggaggatttgatattgacagtaccagcagagacgcctttcataagactctcgtccatctggtcagaaaacacaatcttcttgttgtccagcttggtggcaaatgatccataaagggcattggacagaagcttggcgatggagcgcatggtttggttcttttccttgtccgcgcgctccttggcggcgatgttaagctggacgtactcgcgcgccacacatttccattcagggaagatggttgtcagttcatccggaactattctgactcgccatcccctattgtgcagggttatcagatccacactggtggccacctcgcctcggaggggctcattggtccagcagagtcgacctccttttcttgaacagaaaggtgggagggggtctagcatgaactcatcaggggggtccgcatctatggtaaatattcccggtagcaaatctttgtcaaaatagctgatggtggcgggatcatccaaggtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacagcgcccccctctgatgcttgctcgcacatagtcatagagttcatgtgagggggcgagaagacccgggcccagattggtgcggttgggtttttccgccctgtaaacgatctggcgaaagatggcatgggaattggaagagatagtaggtctctggaatatgttaaaatgggcatgaggtaggcctacagagtcccttatgaagtgggcatatgactcttgcagcttggctaccagctcggcggtgacgagtacatccagggcacagtagtcgagagtttcctggatgatgtcataacgcggttggcttttcttttcccacagctcgcggttgagaaggtattcttcgcgatccttccagtactcttcgaggggaaacccgtctttttctgcacggtaagagcccaacatgtagaactgattgactgccttgtagggacagcatcccttctccactggaagagagtatgcttgggctgcattgcgcagcgaggtatgagtgagggcaaaagtgtccctgaccatgactttgaggaattgatacttgaagtcaatgtcatcacaggccccctgttcccagagttggaagtccacccgcttcttgtaggcggggttgggcaaagcgaaagtaacatcattgaagaggatcttgccggccctgggcatgaaatttcgggtgattttgaaaggctgagggacctctgctcggttattgataacctgagcggccaagacgatctcatcaaagccattgatgttgtgccccactatgtacagttctaagaatcgaggggtgcccctgacatgaggcagcttcttgagttcttcaaaagtgagatctgtagggtcagtgagagcatagtgttcgagggcccattcgtgcacgtgagggttcgctttgaggaaggaggaccagaggtccactgccagtgctgtttgtaactggtcccggtactgacgaaaatgctgcccgactgccatcttttctggggtgacgcaatagaaggtttgggggtcctgccgccagcgatcccacttgagtttcatggcgaggtcataggcgatgttgacgagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcagcgattcacgggatgcacctcatgaatgagttgtacctgacttcctttgacgagaaatttcagtggaaaattgaggcctggcgtttgtacctcgcgctctactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattgacttgcatgatcttttcgagggcgtgagggaggttcagatggtacttgatctccacgggtccgttggtggagatgtcgatggcttgcagggttccgtgccccttgggtgctaccaccgtgcccttgtttttccttttgggcggcggtggctctgttgcttcttgcatgtttagaagcggtgtcgagggcgcgcaccgggcggcaggggcggttcgggacccggcggcatggctggcagtggtacgtcggcgccgcgcgcgggtaggttctggtactgtgctctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgccaggtcgttggagatgcgcccaatgagttgagagaatgcattcatgcccgcctcgttccagacgcggctgtagaccacagcccccacgggatctctcgcgcgcatgaccacctgggcgaggttgagctccacgtggcgggtgaagaccgcatagttgcatagacgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttgaaaaactgggagttacgcgcggacacggtcaactcctcttccagaagacggatgagttcggcgacggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctctttggagggtgagacgatgctgctggtgatgaaattaaaataggcagttttgagacggcggatggtggcgaggagcaccaggtctttgggtccggcttgttggatgcgcaggcgatgggccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttctgcgaggatggcttgctgcacctgggtgagggtggcttggaagtcgtcaaagtccacgaagcggtggtaagccccggtgttgattgtgtaggagcagttggccatgactgaccagttgactgtctggtgccccggacgcacaatctcggtgtacttgaggcgcgagtaggcgcgggtgtcaaagatgtaatcgttacaggtgcgcaccaggtactggtagccgataagaaagtgcggcggcggctggcggtataggggccatcgctctgtagccggggcgccaggggcgaggtcttccagcatgaggcggtgataaccgtagatgtacctggacatccaggtgataccggaggcggtggtggatgcccgcgggaactcgcgtacgcggttccagatgttgcgcagcggcatgaagtagttcatggtaggcacggtttggcccgtgagacgtgcacagtcgttgatgctctagacatacgggcaaaaacgaaagcggtcagcggctcgtctccgtggcctggaggctaagcgaacgggttgggctgcgcgtgtaccccggttcgaatctcggatcaggctggagccgcagctaacgtggtactggcactcccgtctcgacccaggcctgcacaaaacctccaggatacggaggcgggtcgtttttttttttttttgctttttcctggatgggagccagtgctgcgtcaagctttagaacactcagttctcggggctgggagtggctcgcgcccgtagtctggagaatcaatcgccagggttgcgttgcggtgtgccccggttcgagtcttagcgcgccggatcggccggtttccgcgacaagcgagggtttggcagccccgtcatttctaagaccccgccagccgacttctccagtttacgggagcgagccctctttttttgtttttttgttgcccagatgcatcccgtgctgcgacagatgcgcccccagcaacagcccccttctcagcagcagctacaacaacagccacaaaaggctcttcctgctcctgtaactactgcggctgcagccgtcagcggcgcggggcagcccgcctatgatctggacttggaagagggcgagggactggcgcgcctgggcgcaccatcgcccgagcggcacccgcgggtgcaactgaaaaaggactctcgcgaggcgtacgtgccccagcagaacctgttcagggacaggagcggcgaggagcctgaggaaatgcgagcttcccgctttaacgcgggtcgcgaactgcgtcacggtctggaccgaagacgggtgctgcgtgatgatgattttgaagtcgatgaagtgacaggaataagtcctgctagggcacatgtggccgcggccaacctagtatcagcttacgagcagaccgtgaaggaggagcgcaactttcaaaaatctttcaacaaccatgtgcgcaccctgattgcccgcgaggaagtgacactgggactgatgcacctgtgggacctgatggaagccattacccagaaccccaccagcaaacctctaaccgctcagctgtttctggtggtgcaacatagtagagacaatgaggcatttagggaggcgctgttgaacattactgagcccgaggggagatggttgtatgatcttatcaatattctgcaaagtataatagtgcaagaacgtagcctgggtctagctgagaaggtggctgctattaactactcggtcttgagcctgggcaagcactacgctcgcaagatctacaaaaccccatacgtacctatagacaaggaggtgaagatagatgggttttatatgcgcatgactctcaaggtgctgaccttgagtgacgatctgggagtgtaccgcaacgacaggatgcaccgcgcagtgagcgccagcagaaggcgtgagctgagcgacagagaacttatgcacagcttgcaaagagctctgactggggctggaaccgagggggagaactactttgacatgggagcggacttgcaatggcagcccagtcgcagggccctggacgcagcagggtatgagcttccttacatagaagaggtggatgaaggccaggatgaggagggcgagtacctggaagactgatggcgcgaccatccatatttttgctagatggaacagcaggcaccggaccccgcaaaacgggcggcgctacagagccagccgtccggcattaactcctcggacgattggagccaggccatgcaacgcatcatggcgctgacgacccgcaaccccgaagcctttaggcagcaaccccaggccaaccgcctttctgctatcctggaggccgtagtgccctcccgctccaaccccacacacgagaaggtcctggccatcgtgaacgcgctggtggagaacaaagccatacgtcccgatgaggctgggctggtatacaatgccctattggagcgcgtagcccgctacaacagcagcaacgtgcagaccaacctggaccggatggtgaccgatgtgcgcgaggccgtgtctcagcgcgagcggttccagcgagacgccaatttagggtcgctggtggctttgaacgccttcctcagcactcagcctgccaacgtgcctcgcggtcagcaagactacacaaactttctaagtgcattgagactcatggtggccgaagtccctcaaagcgaagtgtaccagtccgggccagactactttttccagaccagcagacagggcttgcagacagtgaacctgagccaggcttttaagaacctgaatggtctgtggggagtgcgcgccccagtgggagatcgggcgaccgtgtctagcttgctgacccccaactcccgcctactactgctcttggtagccccattcactgacagcggtagcatcgaccgtaattcgtacttgggctatctgttgaacctgtatcgcgaggccatagggcaaactcaggtagatgagcaaacctatcaagaaattacccaagtgagccgcgctctgggtcgggaggacactggcagcttggaagccaccttaaacttcttgctgaccaaccggtcgcagaagatccctcctcagtatgcgcttaccgcggaggaggaacggatcctgagatacgtgcagcagagcgtgggactgttcctaatgcaggagggggcgactcctactgctgcgctcgatatgacagcccgaaacatggagcccagcatgtatgccagtaaccggccttttatcaataaactgctagactacttacacagggcggctgctatgaactctgattatttcaccaatgctatcctgaacccccattggctgcccccacctgggttctatacgggcgagtatgacatgcccgaccccaatgacgggtttttatgggacgatgtggacagtagtgttttctccccgcctcctggttataacacttggaagaaggaaggtggcgatagaaggcactcttccgtgtcactgtccggggcaacgggtgctgccgcagcggctcccgaggccgcaagtcctttccctagtttgccattttcgctaaacagtgtacgcagcagtgagctgggaagaataacccgtcctcgcttgatcggcgaggaggagtatttgaacgactccctgttgagacccgagagggagaagaatttccccaacaacgggatagaaagcttggttgacaaaatgaaccgctggaagacgtacgcgcacgatcacagggacgatccccgggcgctgggggatagccggggcagcgctacccgtaaacgccagtggcacgacaggcagcggggcctggtgtgggccgatgatgattccgccgacgacagcagcgtgttggacttgggtgggagtggtggtaacccgttcgctcacctgcgcccccgcgtcgggcgcctgatgtaagaaaccgaaaataaatactcaccaaggccatggcgaccagcgtgcgttcgtttcttctctgttatatctagtatgatgaggcgaaccgtgctaggcggagcggtggtgtatccggagggtcctcctccttcgtacgagagcgtgatgcagcaggcggcggcggcgacgatgcagccaccactggaggctccctttgtaccccctcggtacctggcacctacggaggggagaaacagcattcgttactcggagctggcaccattgtatgataccacccggttgtatttggtggacaacaagtccgcggacatcgcctcactgaactatcagaacgaccacagcaacttcctcaccacggtggtgcaaaacaatgactttacccccacggaggccagcacccagaccatcaactttgacgagcggtcgcgatggggcggtcagctgaagactatcatgcacaccaacatgcccaacgtgaacgagtacatgtttagcaacaagttcaaagctcgggtgatggtgtctagaaaggctcctgaaggtgtcacagtagatgacaattatgatcacaagcaggatattttggaatatgagtggtttgagtttactctaccggaagggaatttctcagccacaatgaccattgacctaatgaacaatgccatcattgataattaccttgaagtgggcagacagaatggagtgttagagagtgacattggtgttaaatttgacaccaggaactttagactgggttgggatccggaaactaagttgattatgcctggggtttacacctatgaggcattccatcctgacattgtattgttgcctggttgcggagttgactttactgaaagtcgccttagtaacttgcttggtatcaggaaaagacacccattccaggagggttttaagatcttgtatgaggatcttgaagggggtaatatcccggccctgttggatgtagaagcctatgagaacagtaagaaagaacaagaagccaaaacagaagccgctaaagctgctgctattgctaaagccaacatagttgtcagcgaccctgtaagggtggctaatgcagaagaagtcagaggagacaactatacagcttcatctgttgcaactgacgaatcgctattggctgctgtggccgaaactacagagacaaaactcactattaaacctgtagaaaaagacagcaagagtagaagttacaatgtcttggaagataaagtgaatacagcctaccgcagctggtacctgtcctacaactatggtgaccctgaaaaaggagtccgttcctggacactgctcaccacctcggatgtcacctgtggagcagagcaggtgtactggtcgctcccagacatgatgcaggaccctgtcacattccgttccacgagacaagtcagcaactatccagtggtaggtgcagagctcatgccggtcttctcaaagagtttctacaacgagcaagccgtgtactcccagcagcttcgccagtccacctcgctcacgcacgtcttcaaccgcttccctgagaaccagatcctcatccgcccgccagcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctttcaagccgcactttctaaaaaaaaaaatgtccattcttatctcacctagtaataacaccggttggggcctgcgcgcgccaagcaagatgtacggaggtgctcgcaaacgctctacacagcaccctgtgcgcgtgcgcgggcacttccgcgctccatggggcgccctcaagggtcgtgcccgcactagaaccaccgtcgatgatgtgatcgaccaggtggtggccgatgctcgtaattatactcctactgcacctacatctactgtggatgcagttattgacagcgtagtggctgacgcccgcgcctatgctcgccggaagagcaggcggagacgcatcgccaggcgccaccgggctactcccgctatgcgagcggcaagagctctgctacggagggccaaacgcgtggggcgaagagctatgcttagagcggccagacgcgcggcttcaggtgccagtgccggcaggtcccgcaggcgcgcagccacggcggcagcagcggccattgccaacatggcccaaccgcgaagaggcaatgtgtactgggtgcgcgacgccaccaccggccagcgcgtgcccgtgcgcacccgcccccctcgctcttagaagatactgagcagtctccgatgttgtgtcccagcgaggatgtccaagcgcaaatacaaggaagagatgctccaggtcatcgcgcctgaaatctacggtccgccggtgaaggatgaaaaaaagccccgcaaaatcaagcgggtcaaaaaggacaaaaaggaagaagatggcaatgatggtctggcggagtttgtacgcgagttcgccccaaggcggcgtgtgcagtggcgtggacgcaaagtgcggcctgtgctgagacctggaaccacggtggtctttacgcccggcgagcgctccagcactgcttttaagcggtcctatgatgaggtgtatggggatgatgatattctggagcaggcggccgaccgcctgggcgagtttgcttatggcaagcgctcccgctcgagccccaaggaggaggcggtgtccattcccttggacaatgggaatcccacccctagtctcaagccagtcaccctgcagcaagtgctgcccgtgcctccacgcagaggcaacaagcgagagggtgaggatctgtatcccactatgcaattgatggtgcccaagcgccagcggctggaggacgtgctggagaaaatgaaagtggatcccgatatacaacctgaggtcaaagtgagacccatcaagcaggtggcgccaggtttgggagtacaaaccgtagacatcaagattcccaccgagtccatggaagtccaaaccgaacctgcaaagcccacaaccacctccattgaggtgcaaacggatccctggatgaccgcacccgttacaactccagctgctgtcaacaccactcgaagatcccggcgaaagtacggtccagcaagtttgctgatgccaaattatgctctgcacccatccattattccaactccgggttaccgaggcactcgctactaccgcagcaggagcagcacttcccgccgtcgccgcaaaacacctgcaagtcgtagtcaccgtcgtcgccgccgccccaccagcaatctgactcccgctgctctggtgcggagagtgtatcgcgatggccgcgcggatcccctgacgttgccgcgcgtacgctaccatccaagcatcacaacttaacaactgttgccgctgcctccttgcagatatggccctcacttgccgccttcgtgtccccattactggctaccgaggaagaaactcgcgccgtagaagagggatgttggggcgcggaatgcgacgccacaggcggcggcgcgctatcagcaagaggctggggggtggctttctgcctgctctgatccccatcatagccgcggcgatcggggcgataccaggcatagcttccgtggcggttcaggcctcgcagcgccactgacattggaaaaacttataaataaaacagaatggactctgatgctcctggtcctgtgactatgtttttgtagagatggaagacatcaatttttcatccctggctccgcgacacggcacgaggccgtacatgggcacctggagcgacatcggcaccagccaactgaacgggggcgccttcaattggagcagtatctggagcgggcttaaaaattttggctctaccataaaaacctatgggaacaaagcttggaacagcagcacagggcaggcattgagaaataagcttaaagagcaaaacttccaacagaaggtggttgatggaatcgcctctggtatcaatggggtggtggatctggccaaccaggccgtgcagaaacagataaacagccgcattgacccgccgccgtcagccccgggtgaaatggaagtggaggaagatctccctccccttgaaaagcggggcgacaagcgtccgcgccccgatctggaggagacactagtcacacgctcagacgacccgccctcctacgaggaggcagtgaagcttggaatgcccaccaccagacctgtagcccccatggctaccggggtaatgaaaccttctcagtcacaccgacccgctaccttggacttgcctccccctgctgttgcagcgcctgctcgcaagcctgtcgctaccccgaagcccaccaccgtacagcccgtcgccgtagccagaccgcgtcctgggggcactccacgtccgaatgcaaactggcagagtactctgaacagcatcgtgggtctgggcgtgcaaagtgtaaagcgccgtcgctgcttttaaattaaatatggagtagcgcttaacttgcctgtctgtgtgtatgtgtcatcatcacgccgccgccgcagcaacagcagaggagcaaggaagaggtcgcgcgccgaggctgagttgatttcaagatggccaccccatcgatgctgccccagtgggcatacatgcacatcgccggacaggatgcttcggagtacctgagtccgggtctggtgcagttcgcccgcgccacagacacctacttcaatctggggaacaagtttaggaaccccaccgtggcgcccacccatgatgtgaccaccgaccgcagtcagcggctgatgctgcgctttgtgcccgttgaccgggaagacaatacctacgcatacaaagttcgatacaccttggctgtgggcgacaacagagtgctggatatggccagcactttctttgacattcggggtgtgttggatagaggccctagcttcaagccatactctggcactgcttacaactcgttggcccctaagggcgctcccaatacatctcagtggattgctgaaggcgtaaaaaaagaagatgggggatctgacgaagaggaagagaaaaatctcaccacttacacttttggaaatgccccagtgaaagcagaaggtggtgatatcactaaagacaaaggtcttccaattggttcagaaattacagacggcgaagccaaaccaatttatgcagataaactataccaaccagaacctcaggtgggagatgaaacttggactgacacagatggaacaactgagaagtatggtggtagagctctaaagccagaaactaaaatgaaaccctgctatgggtcttttgctaaacccactaacgtcaaaggcggacaggcaaaacaaaaaactactgaacaaccgcaaaaccagcaggttgaatatgatattgacatgaacttttttgatgaagcgtcacagaaagcaaacttcagtccaaaaattgtgatgtatgcagaaaatgtagacttggaaaccccagacactcatgtggtgtacaaacctggtacttcagaagaaagttctcatgctaatctgggtcaacaatctatgcccaacagacccaactacattggctttagagataactttattggacttatgtactacaacagtactggcaacatgggagtgctggcaggtcaagcatcccaattgaatgcggtggttgacttgcaggacagaaacacagaactatcatatcaactactgcttgactctctgggtgacagaaccagatacttcagcatgtggaatcaagcagtcgatagctatgatcctgatgtgcgcattattgaaaatcatggggtggaagatgagcttcccaactactgctttccattggatggagtaggggtaccaataagtagttacaaaataattgaaccaaacggacagggtgcagattggaaagagcctgacataaatggaacaagtgaaattggacaaggaaatctctttgccatggaaattaacctccaagctaatctctggagaagttttctttattccaatgtggctctgtatctcccagactcctacaaatacaccccagccaatgtcactcttccaactaacaccaacacttatgactacatgaatgggcgggtggttcccccatccctggtggatacctacgtaaacattggcgccagatggtctttggatgccatggacaatgtcaacccctttaaccatcaccgcaacgctggcctgcgataccggtccatgcttttgggcaatggtcgttacgtgcctttccacattcaagtgcctcagaaattctttgctgtgaagaacctgctgcttctacccggttcttacacctacgagtggaacttcagaaaggatgtgaacatggtcctgcagagttcccttggtaatgatctccgggtcgatggtgccagcataagttttaccagcatcaatctctatgccaccttcttccccatggcccacaacactgcctccacccttgaagccatgctgcgcaatgacaccaatgatcaatcattcaatgactacctttctgctgccaacatgctctaccccatcccggccaacgctaccaacgttcccatctccattccctctcgcaactgggccgccttcagaggctggtccttcaccagactcaaaaccaaggagactccctctttgggatcagggttcgatccctactttgtttactctggttctataccctacctggatggtaccttctaccttaaccacactttcaagaaagtctccatcatgtttgactcttcagtgagctggcctggtaatgacagattgctaagtccaaatgagttcgaaatcaagcgcacagttgatggggaaggctacaatgtggcccaatgtaacatgaccaaagactggttcctggtccagatgcttgccaactacaacattggataccagggcttctacgttcctgagggttacaaggatcgcatgtactccttcttcagaaacttccagcccatgagtagacaggtggttgatgagattaactacaaagactataaagctgtcgccgtaccctaccagcataataactctggctttgtgggttacatggctcctaccatgcgtcagggtcaagcgtaccctgctaactacccataccccctaattggaaccactgcagtaaccagtgtcacccagaaaaaattcctgtgcgacaggaccatgtggcgcatcccattctctagcaacttcatgtccatgggtgcccttacagacctgggacagaacttgctgtatgccaactcggcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgtcatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccgcgctcagccgcctgtggacttttttgctgtatgttccttcatgcctttgtgcactggcccgaccgccccatgaacggaaaccccaccatgaagttgctgactggggtgtcaaacagcatgctccaatcaccccaagtccagcccaccctgcgtcgcaaccaggaggcgctatatcgcttcctaaacacccactcatcttactttcgttctcaccgcgcacgcatcgaaagggccaccgcgtttgaccgtatggatatgcaataagtcatgtaaaaccgtgttcaataaaaagcactttatttttacatgcactaaggctctggttttttgctcattcgttttcatcattcactcagaaatcaaatgggttctggcgtgagtcagagtgacccgtgggcagggagacgttgcggaactgtaacctgttctgccacttgaactcggggatcaccagcttgggaactggaatttcgggaaaggtgtcttgccacaactttctggtcagttgcagggcgccaagcaggtcaggagcagagatcttgaaatcacagttggggccggcattctggacacgggagttgcggtacactgggttgcaacactggaacaccatcaaggctgggtgtctcacgcttgccagcacggtcgggtcactgatggtagtcacatccaagtcttcagcattggccattccaaagggggtcatcttacaggtctgcctgcccatcacgggagcgcagcctggcttgtggttgcaatcgcaatgaatggggatcagcatcatcctggcttggtcgggggttatccctgggtacacggccttcatgaaggcttcgtactgcttgaaagcttcctgagccttacttccctcggtgtaaaacatcccacaggacttgctggaaaattggttagtagcacagttggcatcattcacacagcagcgggcatcgttgttggccaactggaccacatttctgccccagcggttctgggtgatcttggctctgtctgggttctccttcatagcgcgctgcccgttttcgctcgccacatccatctcgataatgtggtccttctggatcataatagtgccatgcaggcatttcaccttgccttcgtaatcggtgcatccatgagcccacagagcgcacccggtgcactcccaattattgtgggcgatctcagaataagaatgcaccaatccctgcatgaatcttcccatcatcgctgtcagggtcttcatgctactaaatgtcagcgggatgccacggtgctcctcgttcacatactggtggcagatacgcttgtactgctcgtgctgctctggcatcagcttgaaagaggttctcaggtcattatccagcctatacctctccattagcacagccatcacttccatgcccttctcccaggcagataccaggggcaagctcaaaggattcctaacagcaatagaagtagctcctttagctatagggtcattcttgtcgatcttctcaacacttctcttgccatccttctcaatgatgcgcaccggggggtagctgaagcccacggccaccaactgagcctgttctctttcttcttcgctgtcctggctgatgtcttgcagagggacatgcttggtcttcctgggcttcttcttgggagggatcgggggaggactgttgctccgttccggagacagggatgaccgcgaagtttcgcttaccagtaccacctggctctcgatagaagaatcggaccccacgcgacggtaggtgttcctcttcgggggcagaggtggaggcgactgagatgggctgcggtccggccttggaggcggatggctggcagagcccattccgcgttcgggggtgtgctcccgttggcggtcgcttgactgatttcctccgcggctggccattgtgttctcctaggcagagaaacaacagacatggaaactcagccatcactgccaacatcgctgcaagcgccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaccaggaggctggcctcggggatcatgttgccgactacctctccgggcttgggggggaggacgtgctcctcaaacatctagcaaggcagtcgatcatagttaaagacgcactactcaacctcaccgaagtgcccatcagtgtggaagagcttagccgcgcctacgagctgaacctcttttcgcctcagataccccccaagcggcagcgaaacggcacctgcgaggccaaccctcgactcaacttctatccagcttttactgtccccgaagtgctggccacctaccacatcttttttaagaaccaaaagattccagtctcctgccgcgccaaccgcacccgcgcagatgcccttctcaacttgggtccgggagctcgtttacctgatatagcttccttggaagaggttccaaagatctttgagggtctgggaagtgatgagactcgggccgcaaatgctctgcaacagggagagaatggcatggatgaacatcacagcgctctagtggaactggagggtgacaatgcccggcttgcagtgctcaagcgcagtatcgtggtcacccattttgcctaccccgctgttaacctgccgcccaaagtcatgagcgctgtcatggaccatctgctcatcaaacgagcaagtccactttcagaaaaccagaacatgcaggatccagacgcctcggacgagggcaagccggtagtcagtgacgagcagctatctcgctggctgggtaccaactccccccgagatttggaagaaagacgcaagcttatgatggctgtagtgctagtaactgttgagttggagtgtctgcgccgcttttttaccgaccccgagaccctgcgcaagctagaggagaacctgcactacaccttcagacatggcttcgtgcgccaggcatgcaagatctccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaaccttaaagagctggacaagctcttgcagagatccctcaaagccctgtggacaggttttgacgagcgcaccgtcgcctcggacctggcggacatcatcttccccgagcgtcttagggttactctgcgaaacggcctgccagacttcatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctattccgcctggccaactacctctcctaccactcggatgtgatagaggatgtgagcggagacggcctgctggaatgccactgccgatgcaatttatgcacaccccaccgctccctcgcctgcaacccccagttgctaagcgagacccagatcatcggcaccttcgagttgcagggtcccaacagtgaaggcgaggggtcttctccggggcagagtctgaaactgacaccggggctgtggacctccgcctacctgcgcaagttttatcccgaggactatcatccctatgagatcaggttctatgaggaccagtcacatcctcccaaagtcgagctctcagcctgcgtcatcacccagggggcaattctggcccaattgcaagccatccaaaaatcccgccaagaatttctgctgaaaaagggaagcggggtctaccttgacccccagaccggtgaggagctcaacacaaggttcccccaggatgtcccatcgccgaggaagcaagaagctgaaggtgcagctgtcacccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgatttccaaacccgaccaccgcttccaagaccggtaagaaggagcgacagggatacaagtcctggcgtggacataaaaacgctatcatctcctgcttgcatgaatgcgggggcaacatatccttcacccggcgatacctgcttttccaccacggtgtgaacttcccccgcaatatcttgcattactaccgtcacctccacagcccctactgcagtcagcaagtcccggcaaccccgacagaaaaagacagcagcgacaacggtgaccagaaaaccagcagttagaaaatccacaacaagtgcagcaggaggaggactgaggatcacagcgaacgagccagcgcagaccagagagctgaggaaccggatctttccaaccctctatgccatcttccagcagagtcgggggcaagagcaggaattgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgctcattcgaaaacggcgggaatcacgtcacccttggcagctgtcctttgccctcgtcatgagtaaagacattcccacgccttacatgtggagctatcagccccaaatggggttggcagcaggtgcttcccaggactactccacccgcatgaattggcttagcgccgggccctcaatgatatcacgggttaatgatatacgagcttatcgaaaccagttactcctagaacagtcagctcttaccaccacaccccgccaacaccttaatccccgaaattggcccgccgccctggtgtaccaggaaaatcccgctcccaccaccgtactacttcctcgagacgcccaggccgaagttcagatgactaacgcaggtgtacagctggcgggcggttccgccctatgtcgtcaccggcctcaacagagtataaaacgcctggtgatcagaggccgaggtatccagctcaacgacgagtcggttagctcttcgcttggtctgcgaccagacggagtcttccagatcgccggctgtgggagatcttccttcactcctcgtcaggctgtgctgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattgatgtctaatggtggcgcggctgagctagctcgactgcgacacctagaccactgccgccgctttcgctgtttcgcccgggaactcaccgagttcatttacttcgaactctccgaggagcaccctcagggtccggcccacggagtgcggattaccatcgaagggggaatagactctcgcctgcatcgcatcttctcccagcggcccgtgctgattgagcgcgaccagggaaatacaaccatctccatctactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctctgatccaggactctaactctaccttaccagcaccctccactactaaccttcccgaaactaacaagcttggatctcatctgcaacaccgcctttcacgaagccttctttctgccaatactaccactcccaaaaccggaggtgagctccgcggtcttcctactgacgacccctgggtggtagcgggttttgtaacgttaggattagttgcgggtgggcttgtgctaatcctttgctacctatacacaccttgctgtgcatatttagtcatattgtgctgttggtttaagaaatgggggccatactagtcgtgcttgctttactttcgcttttgggtctgggctctgctaatctcaatcctcttgatcacgatccatgtctagacttcgacccagaaaattgcacacttacttttgcacccgacacaagccgtctctgtggagttcttattaagtgcggatgggactgcaggtccgttgaaattacacataataacaaaacatggaacaatacattatccaccacatgggaaccaggagttcccgagtggtatactgtctctgtccgaggtcctgacggttccattcgcattagtaacaacactttcattttttctgaaatgtgcgatctggccatgtttatgagcaaacagtatgacctatggcctcctagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactgaaccaatatttgtaatctgtaacagacaaaatctcacgttaattaatgttagcaaaatttataacggttactattatggttatgatagatccagtagtcaatataaaaattacttagttcgcataactcagcccaaatcaacagtgccaactatgacaataattaaaatggctaataaagcattagaaaattttacattaccaacaacgcccaatgaaaaaaacattccaaattcaatgattgcaattattgcggcggtggcattgggaatggcactaataataatatgcatgttcctatatgcttgttgctataaaaagtttcaacataaacaggatccactactaaattttaacatttaattttttatacagatgatttccactacaatttttatcattactagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtacaaaattttcatgcaacggaagagacttgaccattattaacataacattaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttcgaaaaatcgctttaagtaattccacagcagctcccaatacaattcctaaatcaacaattggcatcattactgccgtggtagtgggattaatgattatatttttgtgcataatgtactacgcctgctgctatagaaaacatgaacaaaaaggtgatgcattactaaattttgatatttaattttttatagaattatgatattgtttcaatcaaatgccactaacactctcaatgtgcagactactttaaaacatgacatggaaaaccacactacctcctatgcatacacaaatattcagcctaaatacgctatgcaactagaaatcaccatactaattgtaattggaattcttacactatctgttattctttattttatattctgccgtcaaatacccaatgttcatagaaattctaaaagacgtcccatctattctcctatgattagtcgtccccatatggctctgaatgaaatctaagatctttttttttcttttacagtatggtgaacatcaatcatgattcctagaaatttcttcttcaccatactcatctgtgctttcaatgtctgtgctactttcacagcagtagccactgcaagcccagactgtataggaccatttgcttcctatgcactttttgcctttgttacttgcatctgcgtgtgtagcatagtctgcctggttattaattttttccaactggtagactggatctttgtgcgaattgcctacctacgtcaccatcccgaataccgcaatcaaaatgttgcggcacttcttaggcttatttaaaaccatgcaggctatgctaccagttattttaattctgctactaccctgcattgccctaccttccaccgccactcgcgctacacctgaacaacttagaaaatgcaaatttcaacaaccatggtcatttcttgattgctaccatgaaaaatctgattttcccacatactggatagtgattgttggaataattaacatactttcatgtaccgttttctcaatcacaatataccccacatttaattttgggtggaattctcccaatgcactgggttacccacaagaactagatgaacatatcccactacaacacatacaacaaccactagcattggtagagtatgaaaatgagccacaaccttcactgcctcctgctattagttacttcaacctaaccggcggagatgactgaaatactcaccacctccaattccgccgaggatctgcttgatatggacggccgcgcctcagaacagcgactcgcccaactacgcatccgccagcagcaggaacgcgtgaccaaagagctcagagatgtcatccaaattcaccaatgcaaaaaaggcatattttgtttggtaaaacaagccaagatatcctacgagatcaccgctactgaccatcgcctttcttacgaacttggcccccaacgacaaaaatttacatgcatggtgggaatcaaccctatagttatcacccagcaaagtggagatactaagggttgcattcactgctcttgcgattccaccgagtgcacctacaccctgctgaagaccctatgcggcctaagagacctgctacccatgaattaaaaattaataaaaaattacttacttgaaatcagcaataaggtctctgttgaaattttttcccagcagcacctcgcttccctcttcccaactctggtattctaaaccccgttcagcggcatactttctccatactttaaatgggatgtcaaattttagctcctctcctgtacccacgatcttcatgtctttcttcccagatgaccaagagagtccggctcagtgattccttcaaccctgtctacccctatgaagatgaaagcacctcccaacacccctttataaacccagggtttatttccccaaatggctttacacaaagcccagacggagttcttactttaaattgtttaaccccactaacaaccacaggcgggcctttacagttaaaagtgggagggggacttatagtggatgacactgatgggaccttacaagaaaacatacgtgctacagcacccattactaaaaataatcattctgtagaactatccattggaaatggattagaaacacaaaacaataaactatgtgccaaattgggaaatgggttaaaatttaacaacggtgacatttgtataaaggatagtattaacaccttatggactggaataaagcctccacctaactgtcaaattgtggaaaacactgatacaaacgatggcaaacttactttagtattagtaaaaaacggagggcttgttaatggctacgtatctctagttggtgtatcagacactgtgaaccaaatgttcacacaaaagtcagcaaccatacaattaagattatatttcgactcttctggaaatctattaactgatgaatcaaacttaaaaattccacttaaaaataaatcttctacagcaaccagtgaagctgcaaccagcagcaaagcctttatgccaagtactacagcttatccctttaacaccactactagggatagtgaaaactatattcatggaatatgttactatatgactagttatgatagaagtctagttcccttaaacatttctataatgctaaacagccgtacgatttcttccaatgttgcctatgccatacaatttgaatggaatctaaatgcaaaagaatctccagaaagcaacatagctacgctgaccacatccccctttttcttttcttatattagagaagacgacaactaaaaaataaagtttaagtgtttttatttaaaaatcacaaaattcgagtagttattttgcctcccccttcccatttaacagaatacaccaatctctccccacgcacagctttaaacatttggataccattagagatagacatagttttagtttccacattccaaacagtttcagagcgagccaatctggggtcagtgatacataaaaatgcatcgggatagtcttttaaagcgctttcacagtccaactgctgcggatgcgactccggagtctggatcacagtcatctggaagaagaacgatgggaatcataatccgaaaacggaatcgggcgattgtgtctcatcaaacccacaagcagccgctgtctgcgtcgctccgtgcgactgctgtttatgggatcggggtctgcagtgtcctgaagcatgattttaatagcccttaacattaactttctggtgcgatgcgcgcagcaacgcattctgatttcacttagattactacagtatgtacagcacattatcacaatattgtttaataaaccataattaaaagcgctccagccaaaactcatatctgatacaatcgcccctgcatgaccatcataccaaattttaatataaattaaatgtcgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccatgaatcacttgagactgaaaaatatctatagtagcacaacaaagacataaatgcatgcatcttctcataatttttaactcatctggatttaaaaacatatcccaaggaatgggaaactcttgcaaaacagtaaagctggcagaacaaggaagaccacgaacacaacttacactatgcatagtcatagtatcacaatctggcaacagcgggtggtcttcagtcatagaagctcgggtttcattttcctcacatcgtggtaactgggctctggtgtaagggtgatgtctggcgcatgatgtcgagcgtgcgcgcaaccttgtcataatggagttgtttcctgacattctcgtattttgtatagcaaaatgcggccctggcacaacacactcttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgtgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttgaattattcgtgtcagttcttgtggtaaatccaaaccacacattacaaacaggtcacggagggcgccctccaccaccattcttaaacacaccctcataatgacaaaatatcttgctcctgtgtcacctgtagcaaattaagaatggcatcatcaattgacatgcccttggctctaagttcttctctaagttctagttgtaaatactctctcatattatcaccaaactgcttagccaaaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaagaaacattcaaaatctctgggatgcaaatgcaataggttaccgcgctgcgctccaacattgttagttttgaattagtctgcaaaataaaagaaacaagcgtcatatcatagtagcctgtcgaacaggtggataaatcagtctttccatcacaagacaagccacagggtctccagctcgaccctcgtaaaacctgtcatcgtgattaaacaacagcaccgaaagttcctcgcggtggccagcatgaataattcttgatgaagcatataatccagacatgttagcatcagttaaagagaaaaaacagccaacatagcctctgggtataattatgcttaatcttaagtatagcaaagccacccctcgcggatacaaagtaaaaggcacaggagaataaaaaatataattatttctctgccgctgttcaggcaacgtcgcccccggtccatctaaatacacatacaaagcctcatcagccatggcttaccagacaaagaacagcgggcgcacaaagcacaagctctaaagaagctctaaagacactctccaacctctccacaatatatacacaagccctaaactgacgtaatgggagtaaagtataaaaaatcccgccaagcccaacacacaccccgaaactgcgtcagcagggaaaaatacagtttcacttccgcattcccaacaagcgtaagttcctctttctcatggtacgtcacatccgattaacttgcaacgtcattttcccacggtcgcaccgccccttttagccgttaaccccgcagccaatcaccacacagcgcgcacttttttaaattacctcatttgcatattggcaccattccatctataaggtatattatataatagccaagctatttaggtgacactatagaatactcaagctatgcactgagagatcccc

SEQ ID NO: 8 - DNA, 35626 bp, Adenovirus B50
  MISC_FEATURE (1)..(35626): Complete Genome
ctgcaggttaattaaggaagggcgaattctgcagatatccatcacactggcggccgctcgagcatgcatctagagggcccaattcgccctatagtgagtcgtattacaattcactggcccaatcaatataatataccttatagatggaatggtgccaatatgtaaatgaggtaatttaaaaaagtgcgcgctgtgtggtgattggctgcggggtgaacggctaaaaggggcggacatgctgggaggtgacgtgacttatgggggaggagttatgttgcaagttatcgcggtaaaggtgacgtaaaacgaggtgtggtttggacacggaagtagacagttttcccacgcttactgacaggatatgaggtagttttgggcggatgcaagtgaaaattctccattttcgcgcgaaaactgaatgaggaagtgaatttctgagtcatttcgcggttatgacagggtggagtatttgccgagggccgagtagactttgaccgtttacgtggaggtttcgattaccgtgtttttcacctaaatttccgcgtacggtgtcaaagtcctgtgtttttacgtaggtgtcagctgatcgctagggtatttaaacctgtcgagttccgtcaagaggccactcttgagtgccagcgagaagagttttctcctccgcgccgcgagtcagttttgcgctttgaaaatgagacacctgcgattcctgccacaggagattatctccagcgagaccgggatagaaatactggagtttgtggtaaataccctgatgggagatgacccggaaccgccagcgcagcctttcgatccacctacgctgcacgatctgtatgatttagaggtagacgggccggacgatcccaatgaggaagctgtaaatgggttttttactgattctatgctactagctgccgatgaaggattggacataaaccctcctcctgagacccttgataccccaggggtggttgtggaaagcggcagaggtgggataaaattgcctgatctgggagcagctgaaatggacttgcgttgttatgaagagggttttcctccgagtgatgatgaagatggggaaactgaacagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccattttatttacagtaagtgtatttaagtgaaatttaaaggaatagtgtagctgtttaataactgttgaatggtagatttatgtttttacttgtgattttttgtaggtcctgtgtctgatgatgagtcgccttctcctgattcaactacctcacctcctgaaattcaggcgcccgtacctgcaaacgtatgcaagcccattcctgtgaagcctaagtctgggaaacgccctgctgtggataagcttgaggacttgttggagggtggggatggacctttggaccttagtacccggaaactgccaaggcaatgagtgccctgcagctgtgtttatttaatgtgacgtcatgtaataaaattatgtcagctgctgagtgttttattgcttcttgggtggggacttggatatataagtaggagcagatctgtgtggttagcttatagcaacctgctgccatccatggaggtttgggctatcttggaagacctgagacagactaggctactgctagaaaacgcctcggacggagtctctggcttttggagattctggttcggtggtgatctagctaggctagtgtttaggataaaacaggactacagggaagaatttgaaaagttattggacgacagtccaggactttttgaagctcttaacttgggccatcaggctcattttaaggagaaggttttatcagttttagatttttctactcctggtagaactgctgctgctgtagcttttcttacttttatattggataaatggatccgacaaacccacttcagcaagggatacgttttggatttcatagcagcagctttgtggagaacatggaaggctcgcagcatgaggacaatcttagattactggccagtgcagcctctgggagtagcagggatactgagacacccaccgaccatgccagcggttctggaggaggagcagcaggaggacaatccgagagccggcctggaccctccggtggaggagtagctgacctgtttcctgaactgcgacgggtgcttactaggtctacgtccagtggacaggacaggggcattaagagggaaaggaatcctagtgggaataattcaagaaccgagttggctttaagtttaatgagccgtaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacagtatagaattactaaaaagattaatattagaaatgcatgctacatatcagggaatggggcagaggttataatagatacccaagataaagcagcttttagatgttgtatgatgggtatgtggccaggggttgtcggcatggaagcagtaacatttatgaatattaggtttaaaggggatgggtataatggcattgtatttatggctaacactaagctgattctacatggttgtagcttttttgggtttaataatacttgtgtagaagcttgggggcaagttggtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcgaatgagaggccttatcagatgctgacttgcgctggtggacattgcaatattcttgctaccgtgcatatcgtttcccatgcacgcaagaaatggcctgtatttgaacataatgtgattaccaagtgcaccatgcacataggtggtcgcaggggaatgtttatgccttaccagtgtaacatgaatcatgtgaaggtgatgttggaaccagatgccttttccagagtgagcttaacaggaatctttgatatgaatattcaactatggaagatactgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagttcggttctagtggtgaagaaactgactaaagtgagtagtggggcaagatgtggatggagactttcaggttggtaaggtggacagattgggtaaattttgttaatttctgtcttgcagctgccatgagtggaagcgcttcttttgaggggggagtatttagcccttatctgacgggcaggctcccatcatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattacggaagcatcgttgccaattccagttcctctaataacccttcaaccctggctgaggacaagctacttgttctcttggctcagctcgaggccttaacccaacgcttaggcgaactgtctaagcaggtggcccagttgcgtgagcaaactgagtctgctgttgccacagcaaagtctaaataaagatctcaaatcaataaataaagaaatacttgttataaaaacaaatgaatgtttatttggtttttcgcgcgcggtatgccctggaccatcggtctcgatcattgagaactcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatcctgggggaaattatatgcattttggactggatcttgaggttggcaatgttgccgcctagatcccgtctcgggttcatattgtgcagaaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctctggcccgggagcatagtttccctcacatatttgcatttcccaggctttcagttccgagggggggatcatgtccacctgcggggctataaaaaataccgtttctggagccggggtgattaactgggatgagagcaaattcctaagcagctgagacttgccgcacccagtgggaccgtaaatgaccccaattacgggttgcagatggtagtttagggagcgacagctgccgtcctcccggagcaggggggccacttcgttcatcatttcccttacatggatattttcccgcaccaagtccgttaggaggcgctctcccccaagggatagaagctcctggagcgaggagaagtttttcaacggtttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgagcgtccagcgctgctagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgatcggcgccctgcatgtcggccaggtagcagtttaccatgagttcgtagttgagcgcctcggccgcgtggcctttggcacggagcttacctttggaagttttatggcaggcggggcagtagatacatttgagggcatacagcttgggcgcgaggaaaatggattcgggggagtatgcatccgcaccgcaggaggcgcagacggtttcgcactccacgagccaggtcagatccggctcatcggggtcaaaaacaagttttccgccatgttttttgatgcgtttcttacctttggtttccatgagttcgtgtccccgctgggtgacaaagaggctgtccgtgtccccgtagaccgactttatgggcctgtcctcgagcggagtgcctcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagtgggcgggcctctgttcgtcctcactgtcttccggatcactgtccaggagcgccagctgttggggtaggtattctctctcgaaggcgggcatgacctctgcactcaggttgtcagtttctaggaacgaggaggatttgatattgacagtaccagcagagatgcctttcataagactctcgtccatctggtcagaaaacacaatcttcttgttatccagcttggtggcaaatgatccatagagggcattggatagaagcttggcgatggagcgcatggtttggttcttttccttgtccgcgcgctccttggcggcgatgttaagctggacgtactcgcgcgccacacatttccattcagggaagatggttgtcagttcatccggaactattctgactcgccatcccctattgtgcagggttatcagatccacactggtggctacctcgcctcggaggggctcattggtccagcagagtcgacctccttttcttgaacagaaaggggggagggggtctagcatgaactcatcaggggggtccgcatctatggtaaatattcccggtagcaaatctttgtcaaaatagctgatggtggcgggatcatccaaggtcatctgccattctcgaactgccagcgcgcgctcgtaggggttaagaggggtgccccagggcatggggtgggtgagcgcggaggcatacatgccacagatatcgtagacatagaggggctcttcgaggatgccgatgtaagtgggataacagcgcccccctctgatgcttgctcgcacatagtcatagagttcatgtgagggggcgagaagacccgggcccagattggtgcggttgggtttttccgccctgtaaacgatctggcgaaagatggcatgggaattggaagagatagtaggtctctggaatatgttaaaatgggcatgaggtaggcctacagagtcccttatgaagtgggcatatgactcttgcagcttggctaccagctcggcggtgacgagtacgtccagggcacagtagtcgagagtttcctggatgatgtcataacgcggttggcttttcttttcccacagctcgcggttgagaaggtattcttcgcgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttgaggaattgatacttgaagtcgatgtcatcacaggccccctgttcccagagttggaagtccacccgcttcttgtaggcggggttgggcaaagcgaaagtaacatcattgaagaggatcttgccggccctgggcatgaaatttcgggtgattctgaaaggctgagggacctctgctcggttattgataacctgagcggccaagacgatctcatcaaagccattgatgttgtgccccactatgtacagttctaagaatcgaggggtgcccctgacatgaggcagcttcttgagttcttcaaaagtgaggtctgtagggtcagtgagagcatagtgttcgagggcccattcgtgcacgtgagggttcgctttgaggaaggaggaccagaggtccactgccagtgctgtttgtaactggtcccggtactgacgaaaatgctgcccgactgccatcttttctggggtgacgcaatagaaggtttgggggtcctgccgccagcgatcccacttgagttttatggccaggtcataggcgatgttgacgagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcatcgattcacgggatgcacctcatgaatgagttgtacctgacttcctttgacgagaaatttcagtggaaaattgaggcctggcgattgtacctcgcgctctactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattgacttgcatgatcttttcgagggcgtgagggaggttcagatggtacttgatctccacgggtccgttggtggagatgtcgatggcttgcagggttccgtgccccttgggcgctaccaccgtgcccttgtttttccttttgggcggcggtggctctgttgcttcttgcatgtttagaagcggtgtcgagggcgcgcaccgggcggcaggggcggttcgggacccggcggcatggccggcagtggtacgtcggcgccgcgcgcgggtaggttctggtactgcgccctcagaagactcgcatgcgccacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgcgaggtcgttggagatacgcccaatgagttgagagaatgcattcatgcccgcctcgttccagacgcggctgtagaccacagcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttgaaaaactgggagttacgcgcggacacggtcaactcttcttccaaaagacggatgagttcggcgatggtggtgcgcacctcgagctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttattaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctctttggagggtgagacgatgctgctggtgatgaaattaaaataggcagttttgagacggcggatggtggcgaggagcaccaggtctttgggtccggcttgttggatgcgcaggcgatgggccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttctgcgaggatggcttgctgcacctgggtgagggtggcttggaagtcgtcaaagtccacgaagcggtggtaagccccggtgttgattgtgtaggagcagttggccatgactgaccagttgactgtctggtgcccagggcgcacaagctcggtatacttaaggcgcgagtatgcgcgggtgtcaaagatgtaatcgttacaggtgcgcaccaggtactggtagccgatgagaaagtgcggcggcggctggcggtataggggccatcgctctgtagccggggcgccaggggcgaggtcttccagcatgaggcggtgataaccgtagatgtacctggacatccaggtgataccggaggcggtggtggatgcccgcgggaactcgcgtacgcggttccagatgttgcgcagcggcatgaagtagttcatggtaggcacggtttggcccgtgagacgtgcacagtcgttgatgctctagacatacgggcaaaaacgaaagcggtcagcggctcgtctccgtggcctggaggctaagcgaacgggttgggctgcgcgtgtaccccggttcgaatctcggatcaggctggagccgcagctaacgtggtactggcactcccgtctcgacccaggcctgcacaaaacctccaggatacggaggcgggtcgtttttttttttttttgctttttcctggatgggagccaatgctgcgtcaagctttagaacactcagttctcggggctgggagtggctcgcgcccgtagtctggagaatcaatcgccagggttgcgttgcggtgtgccccggttcgagtcttagcgcgccggatcggccggtttccgcgacaagcgagggtttggcagcctcgtcatttctaagaccccgccagccgacttctccagtttacgggagcgagccctctttttttgtttttttgttgcccagatgcatcccgtgctgcgacagatgcgcccccagcaacagcccccttctcagcagcagctacaacaacagccacaaaaggctcttcctgctcctgtaactactgcggctgcagccgtcagcggcgcggggcagcccgcctatgatctggacttggaagagggcgagggactggcgcgcctgggcgcaccatcgcccgagcggcacccgcgggtgcaactgaaaaaggactctcgcgaggcgtacgtgccccagcagaacctgttcagggacaggagcggcgaggagcctgaggaaatgcgagcttcccgctttaacgcgggtcgcgaactgcgtcacggtctggaccgaagacgggtgctgcgtgatgatgattttgaagtcgatgaagtgacaggaataagtcctgctagggcacatgtggccgcggccaacctagtatcagcttacgagcagaccgtgaaggaggagcgcaactttcaaaaatctttcaacaaccatgtgcgcaccctgattgcccgcgaggaagtgacactgggtctgatgcacctgtgggacctgatggaagccattacccagaaccccaccagcaaacctctaaccgctcagctgtttctggtggtgcaacatagtagagacaatgaggcatttagggaggcgctgttgaacattactgagcccgaggggagatggttgtatgatcttatcaatattctgcaaagtataatcgtgcaagaacgtagcctgggtctagctgagaaggtggctgctattaactactcggtcttgagcctgggcaagcactacgctcgcaagatctacaaaaccccatacgtacctatagacaaggaggtgaagatagatgggttttatatgcgcatgactctcaaggtgctgaccttgagtgacgatctgggagtgtaccgcaacgacaggatgcaccgcgcagtgagcgccagcagaaggcgtgagctgagcgacagagaacttatgcacagcttgcaaagagctctgactggggctggaaccgagggggaaaactactttgacatgggagcggacttgcagtggcagcccagtcgcagggccctggacgcagcagggtatgagcttccttacatagaagaggtggatgaaggccaggatgaggagggcgagtatctggaagactgatggcgcgaccatccatatttttgctagatggaacagcaggcaccggaccccgcaaaacgggcggcgctacagagccagccgtccggcattaactcctcggacgattggagccaggccatgcaacgcatcatggcgctgacgacccgcaaccccgaagcctttagacagcaaccccaggccaaccgcctttctgccatcctggaggccgtagtgccctcccgctccaaccccacacacgagaaggtcctggccatcgtgaacgcgctggtggagaacaaagccatacgtcccgatgaggctgggctggtatacaatgccctattggagcgcgtagcccgttacaacagcagcaacgtgcagaccaacctggaccggatggtgaccgatgtgcgcgaggccgtgtctcagcgcgagcggttccagcgagacgccaatttagggtcgctggtggctttgaacgccttcctcagcactcagcctgccaacgtgcctcgcggtcagcaagactacacaaactttctaagtgcattgagactcatggtggccgaagtccctcaaagcgaagtgtaccagtccgggccagactactttttccagaccagcagacagggcttgcagacagtgaacctgagccaggcttttaagaacctgaatggtctgtggggagtgcgcgccccagtgggagatcgggcgaccgtgtctagcttgctgacccccaactcccgcctactactgctcttggtagccccattcactgacagcggtagcatcgaccgtaattcgtacttgggctatctgttgaacctgtatcgcgaggccatagggcaaactcaggtagatgagcaaacctatcaagaaattacccaagtgagccgcgctctgggtcgggaggacactggcagcttggaagccaccttaaacttcttgctgaccaaccggtcgcagaagatccctcctcagtattcgcttaccgcggaggaggaacggatcctgagatacgtgcagcagagcgtgggactgttcctaatgcaggagggggcgactcctactgctgcgctcgatatgacagcccgaaacatggagcccagcatgtatgccagtaaccggccttttatcaataaactgctagactacttacacagggcggctgctatgaactctgattatttcaccaatgctatcctgaacccccattggctgcccccacctgggttctatacgggcgagtatgacatgcccgaccccaatgacgggtttttatgggacgatgtggacagtagtgttttctccccgcctcctggttataacacttggaagaaggaaggtggcgatagaaggcactcttccgtgtcactgtccggagcaacgggtgctgcagcggctcccgaggccgcaagtcctttccctagtttgccattttcgctaaacagtgtacgcagcagtgagctgggaagaataacccgtcctcgcttgatcggcgaggaggagtatttgaacgactccctgttgagacccgagagggagaagaatttccccaacaacgggatagaaagcttggttgacaaaatgaaccgctggaagacgtacgcgcacgatcacagggacgatccccgggcgctgggggatagccggggcatcgctacccgtaaacgccagtggcacgacaggcagcggggcctggtgtgggccgatgatgattccgccgacgacagcagcgtgttggacttgggtgggagtggtggtaacccgttcgctcacctgcgcccccgcgtcgggcgcctgatgtaagaaaccgaaaataaatactcaccaaggccatggcgaccagcgtgcgttcgtttcttctctgttatagctagtatgatgaggcgaaccgtgctaggcggagcggtggtgtatccggagggtcctcctccttcgtacgagagcgtgatgcagcaggcggcggcggcggcgatgcagccaccactggaggctccctttgtaccccctcggtacctggcacctacggaggggagaaacagcattcgttactcggagctggcaccattgtatgataccacccggttgtatttggtggacaacaagtccgcggacatcgcctcactgaactatcagaacgaccacagcaacttcctcaccacggtggtgcaaaacaatgactttacccccacggaggccagcacccagaccatcaactttgacgagcggtcgcgatggggcggtcagctgaagactatcatgcacaccaacatgcccaacgtgaacgagtacatgtttagcaacaagttcaaagctcgggtgatggtgtctagaaaggctcctgaaggtgtcacagtagatgacaattatgatcacaagcaggatattttggaatatgagtggtttgagtttactctaccggaagggaacttctcagccacaatgaccattgacctaatgaacaatgccatcattgataattaccttgaagtgggcagacagaatggagtgttggagagtgacattggtgttaaatttgacaccaggaactttagactgggttgggatccggaaactaagttgattatgcctggggtttacacctatgaggcattccatcctgacattgtattgttgcctggttgcggagttgactttactgaaagtcgccttagtaacttgcttggtatcaggaaaagacacccattccaggagggttttaagatcttgtatgaggatcttgaagggggtaatatcccggccctgttggatgtagaagcctataagaacagtaagaaagaacgagaagccaaaacagaagccgctaaagctgctgctattgctaaagccaacatagttgtcagcgaccctgtaagggtggctaatgccgaagaagtcagaggagacaactatacagcttcatctgttgcaactgaagaatcgctattggctgctgtggccgaaactacagagaccaaactcactattaaacctgtagaaaaagacagcaagagtagaagttacaatgtcttggaagataaagtgaatacagcctaccgcagctggtacctgtcctacaactatggtgaccctgaaaaaggagtccgttcctggacactgctcaccacctcggatgtcacctgtggagcagagcaggtgtactggtcgctcccagacatgatgcaggaccctgtcacattccgttccacgagacaagtcagcaactatccagtggtaggtgcagagctcatgccggtcttctcaaagagtttctacaacgagcaagccgtgtactcccagcagcttcgccagtccacctcgctcacgcacgtcttcaaccgcttccctgagaaccagatcctcatccgcccgccagcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctttcaagccgcactttctaaaaaaaaatgtccattcttatctcacctagtaataacaccggttggggcctgcgcgcgccaagcaagatgtacggaggtgctcgcaaacgctctacacagcaccctgtgcgcgtgcgcgggcacttccgcgctccatggggcgccctcaagggtcgtacccgcactagaaccaccgtcgatgatgtgatcgaccaggtggtggccgatgctcgtaattatactcctactgcacctacatctactgtggatgcagttattgacagcgtagtggctgacgcccgcgcctatgctcgccggaagagcaggcggagacgcatcgccaggcgccaccgggctactcccgctatgcgagcggcaagagctctgctgaggagggccaaacgcgtggggcgaagagctatgcttagagcggccagacgcgcggcttcaggtgccagtgccggcaggtcccgcaggcgcgcagccacggcggcagcagcggccattgccaacatggcccaaccgcgaagaggcaatgtgtactgggtgcgcgacgccaccaccggccagcgcgtgcccgtgcgcacccgcccccctcgctcttagaagatactgagcagtctccgatgttgtgtcccagcgaggatgtccaagcgcaaatacaaggaagagatgctccaggtcatcgcgcctgaaatctacggtccgccggtgaaggatgaaaaaaagccccgcaaaatcaagcgggtcaaaaaggacaaaaaggaagaagatggcaatgatggtctggcggagtttgtacgcgagttcgccccaaggcggcgagtgcagtggcgtggacgcaaagtgcagcctgtgctgagacctggaaccacggtggtctttacgcccggcgagcgctccagcactgcttttaagcggtcctatgatgaggtgtatggggatgatgatattctggagcaggcggccgaccgcctgggcgagtttgcttatggcaagcgctcccgctcgagccccaaggaggaggcggtgtccattcccttggacaatgggaatcccacccctagtctcaagccagtcaccctgcagcaagtgctgcccgtgcctccacgcagaggcaacaagcgagagggtgaggatctgtatcccactatgcaattgatggtgcccaagcgccagcggctggaggacgtgctggagaaaatgaaagtggatcccgatatacaacctgaggtcaaagtgagacccatcaagcaggtggcgccaggtttgggagtacaaaccgtagacatcaagattcccaccgagtcaatggaagtccaaaccgaacctgcaaagcccacaaccacctccattgaggtgcaaacggatccctggatgaccgcacccgttacaactccagctgctgtcaacaccactcgaagatcccggcgaaagtacggtccagcaagtttgctgatgccaaattatgctctgcacccatccattattccaactccgggttaccgaggcactcgctactaccgcagcaggagcagcacttcccgccgtcgccgcaaaacacctgcaagtcgtagtcatcgtcgtcgccgccgccccaccagcaatctgactcccgctgctctggtgcggagagtgtatcgcgatggccgcgcggatcccctgacgttaccgcgcgtacgctaccatccaagcatcacaacttaacaactgttgccgctgcctccttgcagatatggccctcacttgccgccttcgtgtccccattactggctaccgaggaagaaactcgcgccgtagaagagggatgttggggcgcggaatgcgacgccacaggcggcggcgcgctatcagcaagaggctggggggtggctttctgcctgctctgatccccatcatagccgcggcgatcggggcgataccaggcatagcttccgtggcggttcaggcctcgcagcgccactgacattggaaaaacttataaataaaacagaatggactctgatgctcctggtcctgtgactatgtttttgtagagatggaagacatcaatttttcatccctggctccgcgacacggcacgaggccgtacatgggcacctggagcgacatcggcaccagccaactgaacgggggcgccttcaattggagcagtatctggagcgggcttaaaaattttggctctaccataaaaacctatgggaacaaagcttggaacagcagcacagggcaggcattgaaaaataagcttaaagagcaaaacttccaacagaaggtggttgatggaatcgcctctggtatcaatggggtggtggatctggccaaccaggccgtgcagaaacagataaacagccgccttgacccgccgccgtcagcccctggtgaaatggaagtggaggaagatctccctccccttgaaaagcggggcgacaagcgtccgcgccccgatctggaggagacactagtcacacgctcagacgacccgccctcctacgaggaggcagtgaagcttggaatgcccaccaccagacctgtagcccccatggctaccggggtaatgaaaccttctcagtcacaccgacccgctaccttggacttgcctccccctgctgttgcagcgcctgctcgcaagcctgtcgctaccccgaagcccaccaccgtacagcccgtcgccgtagccagaccgcgtcctgggggcactccacgtccgaatgcaaactggcagagtactctgaacagcatcgtgggtctgggcgtgcaaagtgtaaagcgccgtcgctgcttttaaattaaatatggagtagcgcttaacttgcctgtctgtgtgtatgtgtcatcatcacgccgccgccgcagcaacagcagaggagcaaggaagaggtcgcgcgccgaggctgagttgatttcaagatggccaccccatcgatgctgccccagtgggcatacatgcacatcgccggacaggatgcttcggagtacctgagtccgggtctggtgcagttcgcccgcgccacagacacctacttcaatctggggaacaagtttaggaaccccaccgtggcgcccacccatgatgtgaccaccgaccgcagtcagcggctgatgctgcgctttgtgcccgttgaccgggaagacaatacctacgcatacaaagttcgatacaccttggctgtgggcgacaacagagtgctggatatggccagcactttctttgacattcggggtgtgttggatagaggtcctagcttcaagccatattctggcactgcttacaactcattggcccctaagggcgctcccaatacatctcagtggcttaataagggagatgaagaggatggggaagacgaccaacaagctacatacacttttggcaatgcgccagtaaaagccgaagctgaaattacaaaagaaggactgccaataggtttggaagttccatctgaaggtggccctaaacccatttatgctgataaactgtatcagccagaacctcaggtgggagaggaatcttggactgatacggatggcacagatgaaaaatatggaggcagagcacttaaacctgaaactaaaatgaaaccctgctacgggtctttcgctaaacctactaatgttaaaggcgggcaggcaaaagtgaagaaagaagaagaaggcaaggttgaatatgacattgacatgaactttttcgacctaagatcacaaatgactggcctcaagcctaaaattgtaatgtatgcagaaaatgtggatctagaaactcctgacactcatgtggtgtacaaacctggagcttcagatgctagctctcatgcaaaccttggtcaacagtccatgcccaatagacctaactatattggcttcagggacaacttcatcggactcatgtactacaacagtactggcaacatgggagtgctggctggacaagcgtctcagctaaatgcagtggttgacttgcaagacagaaacacagaattgtcatatcaactcttgcttgattctctgggggacagaaccagatatttcagtatgtggaatcaagcagtggatagctatgacccagatgtgcgtgttattgagaaccatggtgtggaagatgaacttcctaactattgttttccattggatggtgtaggtccgcgaatagacagttacaagggaattgagacaaatggtgatgaaaccactacttggaaagatttagagccaaagggcataagtgaaattgctaagggaaatccgtttgccatggaaattaacctccaagctaatctctggagaagttttctttattccaatgtggctctgtatctcccagactcctacaaatacaccccagccaatgtcactcttccaactaacaccaacacttatgactacatgaatgggcgggtggttcccccatccctggtggatacctacgtaaacattggcgccagatggtctttggatgccatggacaatgtcaacccctttaaccatcaccgcaacgctggcctgcgataccggtccatgcttttgggcaatggtcgttacgtgcctttccacattcaagtgcctcagaaattctttgctgtgaagaacctgctgcttctacccggttcttacacctacgagtggaacttcagaaaggatgtgaacatggtcctgcagagttcccttggtaatgatctccgggtcgatggtgccagcataagttttaccagcatcaatctctatgccaccttcttccccatggcccacaacactgcctccacccttgaagccatgctgcgcaatgacaccaatgatcaatcattcaatgactacctttctgctgccaacatgctctaccccatcccggccaacgctaccaacgttcccatctccattccctctcgcaactgggccgccttcagaggctggtccttcaccagactcaaaaccaaggagactccctctttgggatcagggttcgatccctactttgtttactctggttctataccctacctggatggtaccttctaccttaaccacactttcaagaaagtctccatcatgtttgactcttcagtgagctggcctggtaatgacagattgctaagtccaaatgagttcgaaatcaagcgcacagttgatggggaaggctacaatgtggcccaatgtaacatgaccaaagactggttcctggtccagatgcttgccaactacaacattggataccagggcttctacgttcctgagggttacaaggatcgcatgtactccttcttcagaaacttccagcccatgagtagacaggtggttgatgagattaactacaaagactataaagctgtcgccgtaccctaccagcataataactctggctttgtgggttacatggctcctaccatgcgtcagggtcaagcgtaccctgctaactacccataccccctaattggaaccactgcagtaaccagtgtcacccagaaaaaattcctgtgcgacaggaccatgtggcgcatcccattctctagcaacttcatgtccatgggtgcccttacagacctgggacagaacttgctgtatgccaactcggcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgtcatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccgcgctcagccgcctgtggacttttttgctgtatgttccttcatgcctttgtgcactggcccgaccgccccatgaacggaaaccccaccatgaagttgctgactggggtgtcaaacagcatgctccaatcaccccaagtccagcccaccctgcgccgcaaccaggaggcgctatatcgcttcctaaacacccactcatcttactttcgttctcaccgcgcacgcattgaaagggccaccgcgtttgaccgtatggatatgcaataagtcatgtaaaaccgtgttcaataaaaagcattttatttttacatgcactaaggctctggttttttgctcattcgttttcatcattcactcagaaatcaaatgggttctggcgggagtcagagtgacccgtgggcagggagacgttgcggaactgtaacctgttctgccacttgaactcggggatcaccagcttgggaactggaatttcgggaaaggtgtcttgccacaactttctggtcagttgcagggcgccaagcaggtcaggagcagagatcttgaaatcacagttggggccggcattctggacacgggagttgcggtacactgggttgcaacactggaacaccatcaaggctgggtgtctcacgcttgccagcacggtcgggtcactgatggtagtcacatccaagtcttcagcattggccattccaaagggggtcatcttacaggtctgcctgcccatcacgggagcgcagcctggcttgtggttgcaatcgcaatgaatggggatcagcatcatcctggcttggtcgggggttatccctgggtacacggccttcatgaaggcttcgtactgcttgaaagcttcctgagccttacttccctcggtgtaaaacatcccacaggacttgctggaaaattggttagtagcacagttggcatcattcacacagcagcgggcatcgttgttggccaactggaccacatttctgccccagcggttctgggtgatcttggctctgtctgggttctccttcatagcgcgctgcccgttttcgctcgccacatccatctcgataatgtggtccttctggatcatgatagtgccatgcaggcatttcaccttgccttcgtaatcggtgcatccatgagcccacagagcgcacccggtgcactcccaattattgtgggcgatctcagaataagaatgcaccaatccctgcatgaatcttcccatcatcgctgtcagggtcttcatgctactaaatgtcagcgggatgccacggtgctcctcgttcacatactggtggcagatacgcttgtactgctcgtgctgctctggcatcagcttgaaagaggttctcaggtcattatccagcctatacctctccattagcacagccatcacttccatgcccttctcccaggcagataccaggggcaagctcaaaggattcctaacagcaatagaagtagctcctttagctatagggtcattcttgtcgatcttctcaacacttctcttgccatccttctcaatgatgcgcaccggggggtagctgaagcccacggccaccaactgagcctgttctctttcttcttcgctgtcctggctgatgtcttgcagagggacatgcttggtcttcctgggcttcttcttgggagggatcgggggaggactgttgctccgttccggagacagggatgaccgcgaagtttcgcttaccagtaccacctggctctcgatagaagaatcggaccccacgcgacggtaggtgttcctcttcgggggcagaggtggaggcgactgagatgggctgcggtccggccttggaggcggatggctggcagagcccattccgcgttcgggggtgtgctcccgttggcggtcgcttgactgatttcctccgcggctggccattgtgttctcctaggcagagaaacaacagacatggaaactcagccatcactgccaacatcgctgcaagcgccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaccaggaggctggcctcggggatcatgttgccgactacctctccgggcttgggagggaggacgtgctcctcaaacatctagcaaggcagtcgatcatagttaaagacgcactactcaacctcaccgaagtgcctatcagtgtggaagagcttagccgcgcctacgagctgaacctcttttcgcctcagataccccccaagcggcagcgaaacggcacctgcgaggccaaccctcgactcaacttctatccagcttttactgtccccgaagtgctggccacctaccacatcttttttaagaaccaaaagattccagtctcctgccgcgccaaccgcacccgcgcagatgcccttctcaacttgggtccgggagctcgcttacctgatatagcttccttggaagaggttccaaagatctttgagggtctgggaagtgatgagactcgggccgcaaatgctctgcaacagggagagaatggtatggatgaacatcacagcgctctagtggaactggagggtgacaatgcccggcttgcagtgctcaagcgcagtatcgtggtcacccattttgcctaccccgctgttaacctgccgcccaaagtcatgagcgctgtcatggaccatctgctcatcaaacgagcaagtccactttcagaaaaccagaacatgcaggatccagacgcctcggaggagggcaagccggtagtcagtgacgagcagctatctcgctggctgggtaccaactccccccgagatttggaagaaagacgcaagcttatgatggctgtagtgctagtaactgttgagttggagtgtctgcgccgcttttttaccgaccccgagaccctgcgcaagctagaggagaacctgcactacaccttcagacatggcttcgtgcgccaggcatgcaagatctccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaaccttaaagagctggacaagctcttgcagagatccctcaaagccctgtggacaggttttgacgagcgcaccgtcgcctcggacctggcggacatcatcttccccgagcgtcttagggttactctgcgaaacggcctgccagacttcatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctattccgcctggccaactacctctcctaccactcggatgtgatagaggatgtgagcggagacggcctgctggaatgccactgccgatgcaatttatgcacaccccaccgctccctcgcctgcaacccccagttgctaagcgagacccagatcatcggcaccttcgagttgcagggtcccaacagtgaaggcgaggggtcttctccggggcagagtctgaaactgacaccggggctgtggacctccgcctacctgcgcaagtttcatcccgaggactatcatccctatgagatcaggttctatgaggaccagtcacatcctcccaaagtcgagctctcagcctgcgtcatcacccagggggcaattctggcccaattgcaagccatccaaaaatcccgccaagaatttctgctgaaaaagggaagcggggtctaccttgacccccagaccggtgaggagctcaacacaaggttcccccaggatgtcccatcgccgaggaagcaagaagctgaaggtgcagctgtcacccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgatttccaaacccgaccaccgcttccaagaccggtaagaaggagcgacagggatacaagtcctggcgtggacataaaaacgctatcatctcctgcttgcatgaatgcgggggcaacatatccttcacccggcgatacctgcttttccaccacggtgtgaacttcccccgcaatatcttgcattactaccgtcacctccacagcccctactgcagtcagcaagtcccggcaaccccgacagaaaaagacagcagcgacaacggtgaccagaaaagcagcagttagaaaatccacaacaagtgcagcaggaggaggactgaggatcacagcgaacgagccagcgcagaccagagagctgaggaaccggatctttccaaccctctatgccatcttccagcagagtcgggggcaagagcaggaattgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgctcattcgaaaacggcgggaatcacgtcacccttggcagctgtcctttgccctcgtcatgagtaaagagattcccacgccttacatgtggagctatcagccccaaatggggttggcagcaggtgcttcccaggactactccacccgcatgaattggcttagcgccgggccctcaatgatatcacgggttaatgatatacgagcttatcgaaaccagttactcctagaacagtcagctcttaccaccacaccccgccaacaccttaatccccgaaattggcccgccgccctggtgtaccaggaaaatcccgctcccaccaccgtactacttcctcgagacgcccaggccgaagttcagatgactaacgcaggtgtacagctggcgggcggttccgccctatgtcgtcaccggcctcaacagagtataaaacgcctggtgatcagaggccgaggtatccagctcaacgacgagtcggttagctcttcgcttggtctgcgaccagacggagtcttccagatcgccggctgtgggagatcttccttcactcctcgtcaggctgtgctgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattgatgtctaatggtggcgcggctgagctagctcgactgcgacacctagaccactgccgccgctttcgctgtttcgcccgggaactcaccgagttcatctacttcgaactctccgaggagcaccctcagggtccggcccacggagtgcggattaccatcgaagggggaatagactctcgcctgcatcgcatcttctcccagcggcccgtgctgattgagcgcgaccagggaaatacaaccatctccatctactgcatctgtaaccaccccggattgcatgaaagcctttgctgtcttgtttgtgctgagtttaataaaaactgagttaagaccttcctacggactaccgcttcttcaatcaggactttacaacaccaaccagatcttccagaagacccagacccttcctcctctgatccaggactctaactctaccttaccagcaccctccactactaaccttcccgaaactaacaagcttggatctcatctgcaacaccgcctttcacgaagccttctttctgccaatactaccactcccaaaaccggaggtgagctccgcggtcttcctactgacgacccctgggtggtagcgggttttgtaacgttaggattagttgcgggtgggcttgtgctaatcctttgctacctatacacaccttgctgtgcatatttagtcatattgtgctgttggtttaagaaatgggggccatactagtcgtgcttgctttactttcgcttttgggtctgggctctgctaatctcaatcctcttgatcacaatccatgtctagacttcgacccagaaaattgcacacttacttttgcacccgacacaagccgtctctgtggagttcttattaagtgcggatgggactgcaggtccgttgaaattacacataataacaaaacatggaacaataccttatccaccacatgggagccaggagttcccgagtggtatactgtctctgtccgaggtcctgacggttccattcgcattagtaacaacactttcattttttctgaaatgtgcgatctggccatgtttatgagcaaacagtatgacctatggcctcctagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactgaaccaatatttgtaatctgtaacagacaaaatctcacgttaattaatgttagcaaaatttataacggttactattatggttatgatagatccagtagccaatataaaaattacttagttcgcataactcagcccaaatcaacagtgccaactatgacaataattaaaatggctaataaagcattagaaaattttacattaccaacaacgcccaatgaaaaaaacattccaaattcaatgattgcaattattgcggcggtggcattgggaatggcactaataataatatgcatgttcctatatgcttgttgctataaaaagtttcaacataaacaggatccactactaaattttaacatttaattttttatacagatgatttccactacaatttttatcattactagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtacaaaattttcatgcaacggaagagacttgaccattattaacataacattaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttcgaaaaatcgctttaagtaattccacagcagctcccaatacaattcctaaatcaacaattggcatcattactgccgtggtagtgggattaatgattatatttttgtgcataatgtactacgcctgctgctatagaaaacatgaacaaaaaggtgatgcattactaaattttgatatttaattttttatagaattatgatattgtttcaatccaatgccactaacactatcaatgtgcagactactttaaaacatgacatggaaaaccacactacctcctatgcatacacaaatattcagcctaaatacgctatgcaactagaaatcaccatactaattgtaattggaattcttatactatctgttattctttattttatattctgccgtcaaatacccaatgttcatagaaattctaaaagacgtcccatctattctcctatgattagtcgtccccatatggctctgaatgaaatctaagatctttttttttcttttacagtatggtgaacatcaatcatgattcctagaaatttcttcttcaccatactcatctgtgctttcaatgtctgtgctactttcacagcagtagccactgcaagcccagactgtataggaccatttgcttcctatgcactttttgcctttgttacttgcatctgcgtgtgtagcatagtctgcctggttattaattttttccaactggtagactggatctttgtgcgaattgcctacctacgtcaccatcccgaataccgcaatcaaaatgttgcggcacttcttaggcttatttaaaaccatgcaggctatgctaccagttattttaattctgctactaccctgcattgccctaccttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagagctagatgaacatatcccactacaacacatacaacaaccactagcattggtagagtatgaaaatgagccacaaccttcactgcctcctgctattagttacttcaacctaaccggcggagatgactgaaatactcaccacctccaattccgccgaggatctgcttgatatggacggccgcgcctcagaacagcgactcgcccaactacgcatccgccagcagcaggaacgcgtgaccaaagagctcagagatgtcatccaaattcaccaatgcaaaaaaggcatattttgtttggtaaaacaagccaagatatcctacgagatcaccgctactgaccatcgcctctcttacgaacttggcccccaacgacaaaaatttacatgcatggtgggaatcaaccctatagttatcacccagcaaagtggagatactaagggttgcattcactgctcttgcgattccaccgagtgcacctacaccctgctgaagaccctatgcggcctaagagacctgctacccatgaattaaaaattaataaaaaattacttacttgaaatcagcaataaggtctctgttgaaattttttcccagcagcacctcgcttccctcttcccaactctggtattctaaaccccgttcagcggcatactttctccatactttaaaggggatgtcaaattttagctcctctcctgtacccacgatcttcatgtctttcttcccagatgaccaagagagtccggctcagtgattccttcaaccctgtctacccctatgaagacgaaagcacctcccaacacccctttataaacccagggtttatttccccaaatggctttacacaaagcccagacggagttcttactttaaattgtttaaccccactaacaaccacaggcgggcctttacagttaaaagtgggagggggacttatagtggatgacactgatgggaccttacaagaaaacatacgtgttacagcacccattactaaaaataatcattctgtagaactatccattggaaatggattagaaacacaaaacaataaactatgtgccaaattgggaaatgggttaaaatttaacaacggtgacatttgtataaaggatagtattaacaccttatggactggaataaagcctccacctaactgtcaaatagtggaaaacactgatacaaacgatggcaaacttactttagtattagtaaaaaacggaggacttgttaatggctacgtatctctagttggtgtatcagacactgtgaaccaaatgttcacacaaaagtcagcaaccatacaattaagattatatttcgactcttctggaaatctattaactgatgaatcaaacttaaaaattccacttaaaaataaatcttctacagcaaccagtgaagctgcaaccagcagcaaagcctttatgccaagtactacagcttatccctttaacaccactactagggatagtgaaaactatattcatggaatatgttactatatgactagttatgatagaagtctagttcccttaaacatttctataatgctaaacagccgtacgatttcttccaatgttgcctatgccatacaatttgaatggaatctaaatgcaaaagaatctccagaaagcaacatagctacgctgaccacatccccctttttcttttcttatattagagaagacgacaactaaaaaataaagtttaagtgtttttatttaaaaatcacaaaattcgagtagttattttgcctcccccttcccatttaacagaatacaccaatctctccccacgcacagctttaaacatttggataccattagagatagacatagttttagtttccacattccaaacagtttcagagcgagccaatctggggtcagtgatacataaaaatgcatcgggatagtcttttaaagcgctttcacagtccaactgctgcggatgcgactccggagtctggatcacagtcatctggaagaagaacgatgggaatcataatccgaaaacggaatcgggcgattgtgtctcatcaaacccacaagcagccgctgtctgcgtcgctccgtgcgactgctgtttatgggatcggggtctgcagtgtcctgaagcatgattttaatagcccttaacattaactttctggtgcgatgcgcgcagcaacgcattctgatttcactgagattactacagtatgtacagcacattatcacaatattgtttaataaaccataattaaaagcgctccagccaaaactcatatctgatacaatcgcccctgcatgaccatcataccaaattttaatataaattaaatgtcgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccatgaatcacttgagactgaaaaatatctatagtagcacaacaaagacataaatgcatgcatcttctcataatttttaactcatctggatttaaaaacatatcccaaggaatgggaaactcttgcaaaacagtaaagctggcagaacaaggaagaccacgaacacaacttacactatgcatagtcatagtatcacaatctggcaacagcgggtggtcttcagtcatagaagctcgggtttcattttcctcacatcgtggtaactgggctctggtgtaagggtgatgtctggcgcatgatgtcgagcgtgcgcgcaaccttgtcataatggagttgtttcctgacattctcgtattttgtatagcaaaacgcggccctggcacaacacactcttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgcgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttgaattattcgtgtcagttcttgtggtaaatccaaaccacacattacaaacaggtcccggagggcgccctccaccaccattcttaaacacaccctcataatgacaaaatatcttgctcctgtgtcacctgtagcaaattaagaatggcatcatcaattgacatgcccttggctctaagttcttctctaagttctagttgtaaatactctctcatattatcaccaaactgcttagccaaaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagaatttcttgtaaaaattgaataaaagaaaaattttccaaagaaacattcaaaatctctgggatgcaaatgcaataggttaccgcgctgcgctccaacattgttagttttgaattagtctgcaaaataaaagaaacaagcgtcatatcatagtagcctgtcgaacaggtggataaatcagtctttccatcacaagacaagccacagggtctccagctcgaccctcgtaaaacctgtcatcgtgattaaacaacagcaccgaaagttcctcgcggtggccagcatgaataattcttgatgaagcatataatccagacatgttagcatcagttaaagagaaaaaacagccaacatagcctctgggtataattatgcttaatcttaagtatagcaaagccacccctcgcggatacaaagtaaaaggcacaggagaataaaaaatataattatttctctgctgctgttcaggcaacgtcgcccccggtccatctaaatacacatacaaagcctcatcagccatggcttaccagacaaagtacagcgggcgcacaaagcacaagctctaaagaagctctaaagacactcttcaacctctccacaatatatacacaagccctaaactgacgtaatgggagtaaagtgtaaaaaatcccgccaagcccaacacacaccccgaaactgcgtcagcagggaaaagtacagtttcacttccgcattcccaacaagcgtaagttcctctttctcatggtacgtcacatccgattaacttgcaacgtcattttcccacggtcgcaccgccccttttagccgttcaccccgcagccaatcaccacacagcgcgcacttttttaaattacctcatttacatattggcaccattccatcgataaggtatatcatattgattggccaagctatttaggtgacactatagaatactcaagctatgcatcaagcttggtaccgagctcggatccactagtaacggccgccagtgtgctggaattcgcccttgtttaaacgcgatcg

SEQ ID NO: 9 - DNA, 35417 bp, Adenovirus B11
  MISC_FEATURE (1)..(35417): Complete Genome
cgatcgcgtttaaacaagggcgaattccagcacactggcggccgttactagtggatccgagctcggtaccaagcttgatgcatagcttgagtattctatagtgtcacctaaatagcttggccatcatcaataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgagaaattggtatttgaagtcgatgtcgtcacaggctccctgttcccagagttggaagtctacccgtttcttgtaggcggggttgggcaaagcgaaagtaacatcattgaagagaatcttaccggctctgggcataaaattgcgagtgatgcgaaaaggctgtggtacttccgctcgattgttgatcacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggatttgcatgtaggaatgatgaccaaagatctaccgccagtgctgtttgtaactggtcccgatactgacgaaaatgccggccaattgccattttttctggagtgacacagtagaaggttctggggtcttgttgccatcgatcccacttgagtttaatggctagatcgtgggccatgttgacgagacgctcttctcctgagagtttcatgaccagcatgaaaggaactagttgtttgccaaaggatcccatccaggtgtaagtttccacatcgtaggtcaggaagagtctttctgtgcgaggatgagagccgatcgggaagaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagttgtacctggcttcccttgacgagaaatttcagtgggaagccgaggcctggcgattgtatctcgtgctcttctatattcgctgtatcggcctgttcatcttctgtttcgatggtggtcatgctgacgagcccccgcgggaggcaagtccagacctcggcgcgggaggggcggagctgaaggacgagagcgcgcaggctggagctgtccagagtcctgagacgctgcggactcaggttagtaggtagggacagaagattaacttgcatgatcttttccagggcgtgcgggaggttcagatggtacttgatttccacaggttcgtttgtagagacgtcaatggcttgcagggttccgtgtcctttgggcgccactaccgtacctttgttttttcttttgatcggtggtggctctcttgcttcttgcatgctcagaagcggtgacggggacgcgcgccgggcggcagcggttgttccggacccgagggcatggctggtagtggcacgtcggcgccgcgcacgggcaggttctggtactgcgctctgagaagacttgcgtgcgccaccacgcgtcgattgacgtcttgtatctgacgtctctgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctttcgacggtggccgcgaggtcattggagatacggcccatgagttgggagaatgcattcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcaatgtgttcggcgacgaagaaatacatgatccatcgtctcagcggcatttcgctaacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccgggatctcttcttcctcttctatctcttcttccactaacatctcttcttcgtcttcaggcgggggcggagggggcacgcggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcctagcaaggacaacatcgtaacgttctccattgcttattgcttgtgcgcttgccttcttactgctttactgtgcgtatgcatacacctgcttgtaaccactcgcatcaaaaacgccaataacaaagaaaaaatgccttaacctctttctgtttacagacatggcttctcttacatctctcatatttgtcagcattgtcactgccgctcatggacaaacagtcgtctctatccctctaggacataattacactctcataggacccccaatcacttcagaggtcatctggaccaaactgggaagcgttgattactttgatataatctgcaacaaaacaaaaccaataatagtaacttgcaacatacaaaatcttacattgattaatgttagcaaagtttacagcggttactattatggttatgacagatacagtagtcaatatagaaattacttggttcgtgttacccagttgaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaatttctttttatacagccatggtttccactaccacattccttatgcttactagtctcgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcattatcgctgcagtgacaattggaatatctattcttgtttttaccataacctactacgcctgctgctatagaaaagacaaacataaaggtgatccattacttagatttgatatttaatttgttctttttttttttatttacagtatggtgaacaccaatcatggtacctagaaatttcttcttcaccatactcatttgtgcatttaatgtttgcgctactttcacagcagtagccacagcaaccccagactgtataggagcatttgcttcctatgcactttttgcttttgttacttgcatctgcgtatgtagcatagtctgcctggttattaattttttccaacttatagactggatccttgtgcgaattgcctacctgcgccaccatcccgaataccgcaaccaaaatatcgcggcacttcttagactcatctaaaaccatgcaggctatactaccaatatttttgcttctattgcttccctacgctgtctcaaccccagctgcctatagtactccaccagaacaccttagaaaatgcaaattccaacaaccgtggtcatttcttgcttgctatcgagaaaaatcagaaattcccccaaatttaataatgattgctggaataattaatataatctgttgcaccataatttcatttttgatataccccctatttgattttggctggaatgctcccaatgcacatgatcatccacaagacccagaggaacacattcccctacaaaacatgcaacatccaatagcgctaatagattacgaaagtgaaccacaacccccactactccctgctattagttacttcaacctaaccggcggagatgactgaaacactcaccacctccaattccgccgaggatctgctcgatatggacggccgcgtctcagaacagcgactcgcccaactacgcatccgccagcagcaggaacgcgcggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccacggtagcatatgcaaatcccaaccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattattgatgcatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattattgatgatgggccagtgaattgtaatacgactcactatagggcgaattgggccctctagatgcatgctcgagcggccgccagtgtgatggatatctgcagaattcgcccttccttaattaacctgcag

SEQ ID NO: 10 - DNA, 32704 bp, Adenovirus B14a
  MISC_FEATURE (1)..(32704): Complete Genome
ctgcaggttaattaaggaagggcgaattctgcagatatccatcacactggcggccgctcgagcatgcatctagagggcccaattcgccctatagtgagtcgtattacaattcactggcccatcatcaataatataccttatagatggaatggtgccaatatgtaaatgaggtgattttaaaaagtgtgggctgtgtggtaattggctgtggggttaacggctaaaaggggcggcgcggccgtgggaaaatgacgttttttgggggtggagtgtttttgcaagttgtcgcggtaaatgtgacgcaaacaaaggctttttttttacggaactacttagtgttcccacggtatttaacaggaaatgaggtagttttggccggatgcaagtaaaaattgttcattttcgcgcgaaaactgaatgaggaagtggttttctgaataatgcggtatttatggcagggtggagtatttgttcagggccaggtagactttgacccattacgtggaggtttcgattaccgcggaggtttcgattaccgtgttttttacctaaatttccgcgtaccgtgtgaaagtcttctgtttttacgtaggtgtcagctgatcgctacggtatttatacctcagggtttgtgtcaagaggccactcttgagtgccagcgagaagagttttctcctctgcgccggcagtttaatattaaaaaaaatgagacacttgcgatttatgcctcaggaaataatttctgctgagactggaaacgaaatactggagtttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcgatactccaggggtgattgtggaaagcggtacaggtgtaagaaaattacctgatttgggttccgtggactgtgatttgcactgctatgaagacgggtttcctttgagtgatgaggaggaccatgaaaaggagcagtctatgcagactgcagcgggtgagggagtgaaggctgccattggttttcagttggattgcccggagcttcctggacatggctgtaagtcttgtgaatttcacaggaaaaatactggagtaaaggaactgttatgttcgctttgttatatgagagcgcactgccactttatttacagtaagtgtgtttaagttaaaatttaaaggaatatgctgtttttcacatgtatattgagtgggaaatttgtgcttcttattataggtcctgtgtctgatgctgatgagtcaccatctcctgattctactacctcacctcctgagattcaagcacctgttcctgtggacgtgcacaagcccattcctgtaaagcttaagcctggaaaacgtccagcagtggaaaaactcgaggacttgttacagggtggggacggacctttggacttgagtacacggaaacggccaagacaataagtgttccatatccgtgtttacttaaggtgacgtcaatatttgtgtgagagtgcaatgtaataaaaatatgttaactgtttactggtttttattgctttttgggcggggactcaggtatataagtagaagcagacctgtgtggttagctcatagaagctggctttgattcatggaggtttgggccattttggaagaccttagaaagactaggcaactgttagagaacgcttcggacggagtctccggtttttggagattctggttcgctagtgaattagctagggtagtttttaggataaaacaggactataaagaagaatttgaaaagttgttggtagattgtccaggactttttgaagctcttaatttgggccatcaagttcactttaaagaaaaagttttatcagttttagacttttcgaccccaggtagaactgccgctgctgtggcttttcttacttttatattagataaatggatcccgcagactcatttcagcaggggatacgttttggatttcgtagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaaaagggagagggcatctagtggtactgatgctagatctgagttggctttaagtttaatgagtcgcagacgtcctgaaaccatttggtggcatgaggtccagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactccagacaagacagttattagatgctgcatgatggatatgtggcctggagtagtcggtatggaagcagtaacttttgtaaatgttaagtttaggggagatggttataatggaatagtgtttatggccaataccaaacttatattgcatggttgtagcttttttggttttaacaatacctgtgtagatgcctggggacaggttagtgtacggggatgtagtttctatgcgtgttggattgccacagctggcagaaccaagagtcaattgtctctgaagaaatgcatattccaaagatgtaacctgggcattcttaatgaaggcgaagcaagggtccgccactgcgcttctacagatactggatgttttattttaattaagggcaatgccagcgtaaagcataacatgatttgcggtgcttccgatgagaggccttatcaaatgctcacttgtgccggagggcattgtaacatgctggctactgtgcatattgtttctcatcaacgcaaaaaatggcctgtttttgatcacaatgtgttgaccaagtgtaccatgcatgcaggtgggcgtagaggaatgtttatgccttaccagtgtaacatgaatcatgtaaaagtgttgttggaaccagatgccttttccagaatgagtctaacaggaatgtttgacatgaacatgcaaatctggaagatcctgaggtatgatgatacaagatcgagggtgcgcgcatgcgaatgcggaggcaagcatgccaggttccagccggtgtgtgtagatgtgactgaagatctgagaccggatcatttggttattgcccgcactggagcagagttcggatccagtggagaagaaactgactaaggtgagtattgggaaaactttggggtgggattttcagatggacagattgagtaaaaatttgtttttctgtcttgcagctgtcatgagtggaaacgcttcttttaatgggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagccgccgctgccgcctctgttgccgctaacactgtgcttggaatgggttactatggaagcatcctggctaattccacttcctctaataacccttctaccctgactcaggacaagttacttgtccttttggcccagctggaggctttgacccaacgtctgggtgaactttctcagcaggtggccgagttgcgagtacaaactgagtctgctgtcggcacggcaaagtctaaataaaaaaaaaaaattccagaatcaatgaataaataaacgagcttgttgttgatttaaaatcaagtgttttttatttcatttttcgcgcacggtatgccctagaccaccgatctcgatcattgagaacacggtggattttttccaaaatcctataaaggtgggattgaatgtttagatacatgggcattaggccgtctttggggtggagatagctccattgaagggattcatgctccggggtagtgttgtaaattacccagtcataacaaggtcgctgtgcatggtgttgcacaatatcttttagaagtaggctgattgccacagataagcccttggtgtaggtgtttacaaaccggttgagctgggaggggtgcattcggggtgaaattatgtgcattttggattggatttttaagttggcaatattgccgccaagatctcgtcttgggttcatgttatgaagtaccaccaagacggtgtatccggtacatttaggaaatttatcgtgcagcttggatggaaaagcgtggaaaaatttggagacacccttgtgtcctccgagattttccatgcactcatccatgataatagcaatagggccgtgggcagcagcgcgggcaaacacgttccgtgggtctgacacatcatagttatgttcctgagttaaatcatcataggccattttaataaatttgggacggagagtacccgattggggtatgaatgttccttcgggccccggagcatagttcccctcacagatttgcatttcccaagctttcagttccgagggtggaatcatgtccacctggggggctataaagaacaccgtttctggggctggggtaattagttgggatgatagcaagtttctgagcaattgagatttgccacatccggtggggccataaatgattccgattacaggttgcagttggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggttttagaccgtcagccatgggcattttggagagagtctgttgcaaaagttctagtctgttccacagttcagtgatgtgttctatggcatctcgatccagcagacctcctcgtttcgcgggtttggacggctcctggagtagggtatgagacgatgggcgtccagcgctgccagggttcggtccttccagggtctcaaagttcgggtcagggttgtttccgtcacagtgaaggggtgtgcgcctgcttgggcgcttgccagggtgcgcttcagactcatcctgctggtcgaaaacttgtgccgcttggcgccctgtatgtcggccaagtagcagtttaccatgagttcgtagttgagcgcctcggctgcgtggcccttggcgcggagcttacctttggaagttttcttgcataccgggcagtataggcatttcagcgcatacagcttgggcgcaaggaaaatggattctggggagtatgcatccgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttttccagtggagtgcctcggtcttcttcgtataggaactctgaccactctgatacaaaggcgcgcgtccaggccagcacaaaggaggctatgtgggaggggtagcgatcgttgtcaaccagggggtccaccttttccaaagtatgcaaacacatgtcactctcttcaacatccaggaatgtgattggcttgtaggtgtatttcacgtgacctggggtcccagctgggggggtataaaagggggcggttctctgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccgcttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcagcgatgttgagttggacatattcgcgtgccaggcacttccattcggggaagatagttgtcaattcatctggcacaattctcacttgccaccctcggttatgcaaggtaattaaatccacactggtggccacctcgcctcgaaggggttcgttggtccagcagagcctacctcctttcctagaacagaaaggtggaagtgggtctagcataagttcatcgggagggtctgcatccatggtaaagattccaggaagtaaatccttatcaaaatagctgatgggagtggggtcatctaaggccatttgccattctcgagctgccagtgcgcgctcatatgggttaaggggactgccccagggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgacggcgctagcagccccggacccaagttggtgcgattgggtttttctgttctgtagacaatctggcgaaagatggcgtgagaattggaagagatggtgggtctttgaaaaatgttgaagtgggcatgaggtagacctacagagtctctgataaagtgggcataagattcttcaagcttggttaccagttgggcggtgacaagtacgtccagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcgaaggtgtctctaaccatgactttgagaaattggtatttaaagtccatgtcgtcacaggctccctgttcccagagttggaagtctacccgtttcttgtaggcggggttgggcaaagcgaaagtaacatcgttgaagagaatcttaccggctctgggcataaaattgcgagtgatgcgaaaaggctgtggtacttccgctcgattgttgatcacctgggcagctaggacgatctcgtcgaagccgttgatgttgtgtcctacaatgtataattctatgaaacgcggcgtgcctctgacgtgaggtagcttattgagctcatcaaaggttaggtctgtagggtcagataaggcgtagtgttcaagggcccattcgtgcagatgaggatttgcatgtaggaatgatgaccaaagatccaccgccagtgctgtttgtaactggtcccgatactgacgaaaatgctggccaattgccattttttctggagtgacacagtagaaggttccgggatcttgttgccatcgatcccacttaagtttaatggctagatcgtgggccatgttgacgagacgctcttctcctgagagtttcatgaccagcatgaaaggaactagttgtttgccaaaggaccccatccaggtgtaagtttccacatcgtaggtcaggaagagtctttctgtgcgaggatgagagccgattgggaaaaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagctgtacctggcttcccttgacgagaaatttcagtgggaagccgaggcctggcgattgtatctcgtgctcttctatattcgctgtattggcctgttcatcttctgtttcgatggtggtcatgctgacgagcccccgcgggaggcaagtccagacctcggcgcgggaggggcggagctgaaggacgagagcgcgcaggctggagctgtccagagtcctgagacgctgcggactcaggttagtaggtagggacagaagattaacttgcatgatcttttccagggcgtgcgggaggtttagatggtacttgatttccacaggttcgtttgtagagacgtcaatggcttgcagggttccgtgtcctttgggtgccactaccgtacctttgttttttcttttgatcggtggtggctctcttgcttcttgcatgcttaaaagcggtgacggggacgcgcgccgggcggcagcggttgttccggacccgggggcatggctggtagtggcacgtcggcgccgcgcacgggcaggttctggtactgcgctctgagaagacttgcgtgcgccaccacgcgtcgattgacgtcttgtatctgacgtctttgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctctcgacggtggccgcgaggtcattggagatacggcccatgagttgggagaatgcattcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcgatgtgttcggcgacaaagaaatacatgatccatcgtctcagcggcatttcgctgacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccggcatctcttcttcctcttctatctcttcttccactaacatctcttcttcgtcttcaggcgggggcggagggggcacgcggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggaaagggcgctgattatacattttattaattggcccgtagggactgcgcgcagagatctaatcgtgtcaagatccacgggatctgaaaacctttcaacgaaagcgtctaaccagtcacagtcacaaggtaggctgagtacggcttcttgtgggcgggggtggttatgtgttcggtctgggtcttctattccttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagccagatctttgtagtagtcttgcatgagccgttctacgggcacttcttcttcacccgttctgccatgcatacgtgtgagtccaaacccgcgcattggttggaccagtgccaagtcagctacaactctttcggcgaggatggcttgctgtacttgggtgagggtggcttgaaagtcatcaaaatccacgaagcggtggtaagccccggtattgatggtgtaagcacagttggccatgactgaccagttaactgtttggtgaccatggcgcacgagctcggtgtatttaaggcgcgaataggcgcgggtgtcaaaaatgtaatcgttgcaggtgcgcaccagatactggtaccctataagaaaatgcggtggtggttggcggtagagaggccattgttctgtagctggagcgccgggggcgaggtcttccaacataaggcggtgatagccgtagatgtacctggacatccaggtgattcctgcggcggtagtggaagcccgaggaaactcgcgtacgcggttccaaatgttgcgtagcggcatgaagtagttcattgtaggcacggtttgaccagtgaggcgcgcgcagtcattgatgctctatagacacgaagaaaatgaaagcgttcagcgactcgactctgtagcctggaggaacgtgaacgggttgggtcgcggtgtaccccggttcaagacttgtactcgagccggccggagccgcggctaacgtggtattggcactcccgtctcgacccagcctacaaaaatccaggatacggaatcgagtcgttttgctggttgctgaatggcagggaagtgagtcctatttttttttttgccgctcagatgcatcccgtgctgcgacagatgcgtccccaacaacagcccccctcgcagcagcagcaaccacaaaaggctgtccctgcaactactgcaactgccgccgtgagcggtgcgggacagcccgcctatgatctggacttggaagagggcgaaggactggcacgtctaggtgcgccctcgcccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaagtgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttactcttggtttgatgcatttgtgggatttgatggaagctatcattcagaaccctactagcaaacctctgaccgcacagctgtttctggtggtgcaacacagcagagacaacgaggctttcagagaggcactgctcaacatcactgaacccgaggggagatggttgtatgatcttatcaacattctacagagtatcatagtgcaggagcggagcctgggcctggccgaaaaggtggctgccatcaattactcggttttaagtttgggaaaatattacgctcgcaagatctacaagactccatacgttcccatagacaaggaggtgaagatagatgggttctacatgcgtatgacgctcaaggtcttgaccctgagcgatgatcttggggtgtaccgcaatgacagaatgcatcgcgccgttagcgccagtaggaggcgcgagttaagcgacagggaactgatgcacagtttgcaaagagctctgactggagctggaacagagggtgagaattactttgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaacgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccattgtaaacgcgttggtggagaacaaagctattcgtccagatgaggccggactggtatacaacgctcttttagaacgcgtggctcgctacaacagtagcaatgtgcaaaccaatttggaccgtatgataacagatgtacgcgaagccgtgtctcagcgtgaaaggttccagcgcgatgccaaccttggttcgctggtggcgttaaatgcttttttgagtactcagcctgctaatgtgccgcgtggtcaacaggattatactaactttttgagtgcgttgagactgatggtatctgaagtacctcagagcgaagtgtatcagtccggacctgactacttctttcagactagcagacagggtttgcagacggtaaatctgagccaagcttttaaaaaccttaaaggtttgtggggagtgcatgccccggtaggagaaagagcaaccgtgtctagcttgttaactccaaactcccgcctattactactgttggtagctcctttcaccgacagcggcagcatcgaccgtaattcctatttgggttacctactaaacctgtatcgcgaagccatagggcaaagccaggtggacgagcagacctatcaagaaattacccaagtcagtcgcgctttgggtcaggaagacactggcagtttggaagccactctgaacttcttgcttaccaatcggtctcagaagatccctcctcaatatgctcttactgcggaggaggagaggatccttagatatgtgcagcagagcgtgggattgtttctgatgcaagagggggcaactccgactgcggcattggacatgacagcgcgaaatatggagcccagcatgtatgccagtaaccggcctttcattaacaaactgctggactacttgcacagagctgccgctatgaactctgattattttaccaatgccatcctaaacccgcactggctgcccccacctggtttctacacgggcgaatatgacatgcccgaccctaatgacgggtttctgtgggacgacgtggacagtaatgttttttcacctctttttgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggaatacctaaacgattccttgctcagaccggcgagagaaaaaaatttcccaaacaatggaatagaaagtttggtggataagatgagtagatggaagacttatgctcaggatcacagagacgagcctgggatcatggggactacaagtagagcgagccgtagacgccagcgtcatgacagacagaggggtcttgtgtgggaagatgaggattcggccgatgatagcagcgtgttggacttgggtgggagaggaaggggcaacccgtttgctcatttgcgccctcgcttgggtggtatgttgtaaaaaaaaaataaaaaggaaaactcaccaaggccatggcgacgagcgtacgttcgttcttctttattatttgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtacctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcagaacaatgactttacccctacggaagccagtacccagaccattaactttgatgaacgatcgcggtggggcggtcagctaaagaccatcatgcatactaacatgcccaacgtaaacgagtatatgtttagtaacaacttcaaagcgcgtgtgatggtgtccagaaaacctcccgaaggtgctgcagttggggatacatatgatcacaagcaggatattttggaatatgagtggttcgagtttactttgccagaaggcaacttttcagttactatgaccattgatttgatgaacaatgccatcatagataactacttgaaagtgggcagacagaatggagtgcttgaaagtgacattggtgttaagttcgacaccaggaacttcaagctgggatgggatcccgaaaccaagttgattatgcctggagtgtatacgtatgaagcctttcatcctgacattgtcttactgcctggctgtggagtggactttaccgaaagtcgtttgagcaaccttcttggtatcagaaaaaaacagccatttcaagagggttttaagattttgtatgaagatttagaaggaggtaatattccggccctcttggatgtagatgcctatgagaacagtaagaaagaacaaaaagccaaaatagaagctgctgcggaagctaaggcaaacatagttgccagcgactctacaagggttgctaacgctggagaggtcagaggagacaattttgcaccaacacctgttccgactgcagaatcattattggccgatgtaactggaggaacggacgtgaaactcactattcaacctgtagaaaaagatagtaagaatagaagctataatgtgttggaagataaaatcaacacagcctatcgcagttggtacctttcgtacaattatggcgatcccgaaaaaggagtgcgttcctggacattgctcaccacctcagatgtcacctgcggagcagagcaggtctactggtcgcttccagacatgatgcaggatcctgtcactttccgctccactagacaagtcagcaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaatgtccattcttatctcgcccagtaataacaccggttggggtctgcgcgctccaagcaagatgtacggaggcgcacgcaaacgttctacccaacatcccgtgcgtgttcgcggtcattttcgcgctccatggggtgccctcaagggccgcactcgcgttcgaaccaccgtcgatgatgtaatcgatgaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtgggacgaagagccatgcttagggcggccagacgtgcagcttcgggcgccagcgccggcaggtcccgcaggcaagcagccgctgtcgcagcggcgactattgccgacatggcccaaacgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgctgaaggatgaaaaaaaaccccgcaaaatcaagcgggctaaaaaggacaaaaaagaagaggaagatggcgatgatgggctggcggagtttgtgcgcgagtttgccccacggcgacgcgtgcaatggcgtggacgcaaagttcgacatttgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataaatcccaaggatgagacagtgtccatacccttggatcatggaaatcccacccctagtcttaaaccggtcactttgcagcaagtgttacccgtaactccgcgaacaggtgttaaacgcgaaggtgaagatttgtatcccactatgcaactaatggtacccaaacgccaaaagttggaggacgttttggagaaagtaaaagtggatccagatattcaacctgaggttaaagtgagacccattaagcaggtagcgcctggtctgggagtacaaactgtagacattaagattcccactgaaagtatggaagtgcaaactgaacccgcaaagcctactgccacctccactgaagtgcaaacggatccatggatgccgatgcctattacaactgacgccgccggtcccactcgaagatcccgacgaaagtacggtccagcaagtctgttgatgcccaactatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatagtagtgcggaacctttgacactgccgcgtgcgcgttaccatccaagtatcatcacttaatcaatgttgccgctgcctccttgcagatatggccctcacttgtcgccttcgcgttcccatcactggttaccgaggaagaaattcgcgccgtagaagagggatgttggggcgcggaatgcgacgctacaggcgacggcgtgctatccgcaagcaattgcggggtggttttttgccagccttaattccaattatcgctgctgcaattggcgcgataccaggcatagcttccgtggcggttcaggcctcgcaacgacattgacattggaaaaaaaagtataaataaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaactttcaacaaaaagtagtcgatgggatagcttccggcatcaatggagtggtagatttggctaatcaggctgtgcagaaaaagataaacagtcgtttggacccgccgccagcaaccccaggtgaaatacaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagcccctatggctaccggggtaatgaaaccttctcagttgcatcgacccgtcactttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccagtgggcatacatgcacatcgccggacaggatgcttcggagtacctgagtccgggtctggtgcagttcgcccgcgccacagacacctacttcaatctgggaaataagtttagaaatcccaccgtagcgccaacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagtttcaaaccctattctggtacggcttacaactctctggctcctaaaggcgctccaaatgcatctcagtggttggataaaggggttgaaactactgaagaacggcaaaatgaagacggggaaaatgacgaaaaagctacatacacttttggcaatgccccagtaaaagccgatgctgacattacaaaagacggactaccaataggtttggaagtcccagctgaaggtgaccctaaacctatctacgctaataagctttaccaaccagaaccccaggtgggacaggaatcgtggactgatacagatggcactgaagaaaaatacggaggcagagtacttaaaccggacactaaaatgaaaccgtgctatgggtcttttgctaaacctactaatgtgaaaggcggacaggcaaaagtgaaaacagaagaaggcaacaacattgaatatgacattgacatgaacttttttgacttaagatcacaaaaacaaggtcttaaacctaagattgtaatgtatgcagaaaatgtggacctggaatctccagatactcatgttgtgtacaaacctgaagtttcagatgctagttcaaatgctaatcttggacagcagtctatgcccaacagacccaactacattggcttcagagataattttattggtcttatgtactataacagtactggtaacatgggggtgctggctggccaagcatctcagttgaatgcagtggttgacttgcaggacagaaacacagaactgtcttaccaactcttgcttgactccctgggcgatagaaccagatactttagcatgtggaatcaggctgttgacagttatgatcccgatgtgcgtgttattgaaaatcatggtgtggaagatgaacttcccaactactgttttccactggacggcatcggtccgcgaacagatagttacaaggagattcagttaaatggagaccaagcttggaaagatgtaaatccaaatggtatcagtgaacttgttaagggaaatccatttgccatggaaattaaccttcaagccaatctatggcgaagtttcctttattccaatgtggctctgtatctcccagactcgtacaaatacaccccgtccaatgtcactcttccagaaaacaaaaacacctacgactacatgaacgggcgggtggtgccgccatctctagtagacacctatgtgaacattggcgccaggtggtctctggatgctatggacaatgtcaacccattcaaccaccaccgtaacgctggcttgcgttaccgatccatgcttttgggtaacggacgttatgtgcctttccacatacaagtgcctcaaaaattcttcgctgtcaaaaacctgctgcttctcccaggctcctacacttatgagtggaacttcaggaaggatgtgaacatggtgctacagagttccctcggtaacgacctacgggtagatggcgccagcatcagtttcacgagcatcaacctctatgctacctttttccccatggctcacaacaccgcttccacccttgaagccatgctgcggaatgacaccaatgatcagtcattcaacgactatctatctgcagctaacatgctctatcccattcctgccaatgcaaccaatattcccatttccattccttctcgcaactgggcggctttcagaggctggtcatttaccagactcaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcccaacgaatttgaaataaagcgcactgtggatggcgaaggctacaatgtagcccaatgcaacatgaccaaagactggttcttggtacagatgctcgccaactacaacataggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaacatgctttatgccaactcagctcatgctctggacatgacctttgaggtggatcccatggatgagcccaccctgctttatcttctcttcgaagttttcgacgtggtcagagtgcatcagccacatcgcggcatcatcgagacagtctacctgcgtacaccgttctcggccggtaacgctaccacgtaaaaagcttcttgcttcttgcaaacagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaacacggccggacgtgagacggggggagagcactggttggctttcggttggaacccacgttctaacacctgctacctttttgatccttttggattctcggatgatcgtcttaaacagatttaccagtttgaatatgagggtctcctgcgccgcagcgctcttgctaccaaggaccgctgtattacgctggaaaaatctacccagaccgtgcagggcccccgttctgccgcctgcggacttttctgctgcatgttccttcatgcctttgtgcactggcctgaccgtcccatggacggaaaccccaccatgaaattgctgactggagtgccaaacaacatgcttcattctcctaaagtccagcccaccctgtgtgacaatcaaaaagcactctaccattttctcaatacccattcgccttattttcgctcccatcgtacacacatcgaaagggccactgcgttcgaccgtatggatgtgcaataatgactcatgtaaacaacgtgttgaataaacagcactttattttttacacgtatcaaggctctggattacttatttatttacaagtcgaatgggttctgacgagaatcagaatgacccgcgggcagtgatacgttgcggaactgatacttgggttgccacttgaattcgggaatcaccaacttgggaaccggtatatcgggtaggatgtcactccacagctttctggtcagctgcaaagctcccagcaggtcaggagccgaaatcttgaaatcacaattaggaccagtgctctgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggattagtatcatcttggcctgatcctgtctgattcctggatacacggctctcatgaaagcatcatattgcttgaaagcctgctgggctttactaccctcggtatagaacatcccgcaggacctgctcgaaaactggttagctgcgcagccggcatcattcacacagcagcgggcgtcattgttggctatttgcaccacacttctgccccagcggttttgggtgattttggttcgctcgggattctccttcaaggctcgttgtccattctcgctggccacatccatctcgataatctgctccttctgaatcataatagtgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgctgctcaggcattagtttaaaagaggttctaagttcgttatccagcctgtacttctccatcagtacacacatcacttccatgcccttctcccaagcagacaccaggggcaagctaatcggattcttaacagtacaggcagcagctcctttagccagaggatcatctttggcaatcttttcaatgcttcttttgccatccttctcaacgatgcgcacgggcgggtagctgaaacctactgctacaagctgcgcctcttctctttcttcttcgctgtcttgactgatgtcttgcatgggaacatgtttggtcttccttggcttctttttggggggtatcgggggaggaggactgtcgctccgttccggagacagggaggattgtgaagtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacaagtgccatcacatctcgtcgtcagcgacgaggaaaaggagcagagcttaaccattccaccgcccagtcctgccaccacctctaccctagaagataaggaggtcgacgcatctcatgacatgcagaataaaaaagcgaaagagtctgaaacagacatcgagcaagacccgggctatgtgacaccggtggaacacgaggaagagttgaaacgctttctagagagagaggatgaaaactgcccaaaacagcaagcggataactatcaccaagatgctggaaatagggatcagaacaccgactacctcatagggcttgacggggaagacgcgctccttaaacatctagcaagacagtcactcatagtcaaggatgcattattggacagaactgaagtgcccatcagtgtggaagagctcagccgcgcctacgagcttaaccttttttcacctcgtactccccccaaacgccagccaaacggcacctgcgagccaaatcctcgcttaaacttttatccagcttttgctgtgccagaagtactcgctacttatcacatcttttttaaaaatcaaaaaattccagtctcctgccgcgctaatcgcacccgcgctgacgccctacttaatctgggacctggttcacgcttacctgatatagcttccttggaagaggttccaaaaatcttcgagggtctgggcaataatgagactcgggccgcaaatgctctgcaaaagggagaaaatggcatggatgagcatcacagcgttctggtggaattggagggcgataatgccagactcgcagtactcaagcgaagcgtcgaggtcacacactttgcataccccgctgtcaacctgccccctaaagttatgacggcggtcatggaccagttactcattaagcgcgcaagtcccctttcagaagacatgcatgacccagacgcctgtgatgagggtaaaccagtggtcagtgatgagcagctaacccgatggctggacaccgactctccccgggatttggaagagcgtcgcaagcttatgatggccgtagtgctggttaccgtagaactagagtgtctccggcgtttctttaccgattcagaaaccttgcgcaaactcgaagagaatctgcactacacttttagacacggctttgtgcggcaggcgtgcaagatatctaacgtggaactcaccaacctggtttcctacatgggtattctgcatgagaatcgtctaggacaaagcgtgctgcacagcacccttaagggggaagcccgccgtgattacatccgcgattgtgtctatctctacctgtgccacacgtggcaaaccggcatgggtgtatggcagcaatgtttagaagaacagaacttgaaagagcttaacaagctcttacagaaatctcttaaggttctgtggacagggttcgacgagcgcaccgtcgcttccgacctggcagacctcatcttcccagagcgtcttagggttactttgcgaaacggactgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactacctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaactgcaaggccccagcagccaaggcgatgggtcttctcctgggcaaagtttaaaactgaccccgggactgtggacctctgcctacttgcgcaagtttgccccggaagattaccacccctatgaaatcaagttctatgaggaccaatcacagcctccaaaggccgaactttcggcctgcgtcatcacccagggggcaattctagcccaattgcaagccatccaaaaatcccgccaagaatttctactgaaaaagggtaagggggtctaccttgacccccagaccggcgaggaactcaacacaaggttccctcaggatgtcccaacgacgagaaagcaagaagttgaaggtgcagccgccgcccccagaagatatggaggaagattgggacagtcaggcagaggaagcggaggaggacagtctggaggacagtctggaggaagacagtttggaggaggaaaacgaggaggcagaggaggtggaagaagtaaccgccgacaaacagttatccccggctgcggagacaagcaacagcgctatcatctccgctccgagtcgaggaacgcggcggcgtcccagcagtagatgggacgagaccggacgcttcccgaacccaaccaccgcttccaagaccggtaagaaggatcggcagggatacaagtcctggcgggggcataagaatgccatcatctcctgcttgcatgagtgcgggggaaacatatccttcacgcgacgctacttgctattccaccatggggtgaactttccacgcaatgttttgcattactaccgtcacctccacagcccctactatagccagcaaatcccggcaatctcgacagaaaaagacagcggcggcgacctccaacagaaaaccagcagcggcagttaaaaaatacacaacaagtgcagcaacaggaggattaaagattacagccaacgagccagcgcaaacccgagagctaagaaatcggatctttccaaccctgtatgccatcttccagcagagtcggggccaagagcaggaactgaaaataaaaaaccgatctttgcgttcgctcaccagaagttgtttgtatcacaagagcgaagatcaacttcagcgcactcttgaggacgccgaggctctcttcaacaagtactgcgcgctgactcttaaagagtaggcagcgaccgcgcttattcaaaaaaggcgggaattacatcatcctcgtcatgagtaaagaaattcccacgccttacatgtggagttatcagccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtataccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgattagaggccgaggtattcagcttaacgacgagtcggtgagctctccgcttggtctacgaccagacggaatctttcaaattgccggctgcgggagatcttccttcacccctcgtcagactgttttgactttggaaagttcgtcttcgcaaccccgctcgggcggaatcgggaccgttcaatttgtggaggagtttactccctctgtctacttcaaccctttctccggatctcctgggcactacccggacgagttcataccgaactttgacgcaattagcgagtcagtggacggctacgattgatgtctggtgacgcggctgagctatctcggctgcgacatctagaccactgccgccgctttcgctgttttgcccgggaactcattgagttcatttacttcgaactccccaaggatcaccctcaaggtccggcccacggagtgcggattactatcgaaggtaaaataaactctcgcctgcatcgaattttctcccagcggcccgtgctgatcgagcgagaccagggaaacaccacggtttctatctactgcatttgtaatcacccaggattgcatgaaagcctttgctgtcttatgtgtactgagtttaataaaaactgaattaagactctcctacggactgccgcttcttcaacccggattttacaaccagaagaacgaaacttttcctctcatccaggactctgttaactttacctttcctacttacaaaccagaagctcaacgacaacaccgcttttccagaagcattttccctactaatactactttcaaaaccggaggtgagctccacagtctccccgcagaaaacccttgggtggaagcgggccttgtagtgctaggaattcttgcgggcgggcttgtgattattctttgctacctatacacaccttgcttcactttcctagtggtgttgtggtattggtttaaaaaatggggcccatactagtcttgcttgttttactttcgcttttgggaccgggttctgccaactacaacactcaccacctccaattccgccgaggatctgcttgatatggacggccgcgtctcagaacagcgactcgcccaactacgcatccgccagcagcaggaacgcgtggccaaagagctcagagatgtcatccaaattcaccaatgcaaaaaaggcatattctgtttggtaaaacaagccaaaatatcctacgagatcaccgctaccgaccatcgcctctcttacgagcttggcccccaacgacaaaaatttacctgcatggtgggaatcaaccccatagttatcacccaacaaagtggagatactaagggttgcattcactgctcctgcgattccatcgagtgcacctacaccctgctgaagaccctatgcggactaagagacctgctacccatgaattaaaaaaatgattaataaaaaatcacttacttaaaatcagcaataaggtctctattgaaattttctcccagcagcacctcacttccctcttcccaactctggtattctaaaccccgttcagcggcatactttctccatactttaaaggggatgtcaaattttagctcctctcctgtacccacaatcttcatctctttcttcccagatgaccaagagagtccggctcagtgactccttcaaccctgtctacccctatgaagatgaaagcacctcccaacacccctttataaacccagggtttatttccccaaatggcttcacccaaagcccagacggagttcttactttaaaatgtttaaccccgctaacaaccacaggcgggtctctacagctaaaagtgggagggggacttacagtagatgacactgatgggaccttacaagaaaacataggtgccaccacaccacttgttaagactgggcactctataggtttatccctaggagccggattgggaacagatgaaaataaactttgtaccaaattgggagaaggacttacattcaattcaaacaacatttgcattgatgacaatattaacaccctgtggacaggagttaaccccaccgaagccaactgtcaaatgatggactccagtgaatctaatgattgcaaattaattctaacactagttaaaactggagccctagtcactgcatttgtttatgttataggagtatctaacaattttaatatgctaactacatacagaaatataaattttactgcggagctgttttttgattctgcgggtaatttactaactagcctgtcatccctaaaaactccacttaatcataaatcaggacaaaacatggctactggtgccattactaatgctaaaagtttcatgcccagcacaactgcttatcctttcaataataattctagagaaaaagaaaactacatttacggaacttgtcactacacagctagtgatcacactgcttttcccattgacatatctgtcatgcttaaccaaagagcaataagagctgatacatcatattgtattcgtataacttggtcctggaacacaggagatgccccagaggggcaaacctctgctacaaccctagttacctccccatttaccttttactacatcagagaagacgactgacaaataaagtttaacttgtttatttgaaaatcaattcacaaactccgagtagttattttgcctcccccttcccatttaacagaatataccaatctctccccacgcacagctttaaacatttggataccattagagatagacatggttttagattccacattccaaacagtttcagagcgagccaatctggggtcagtgatagataaaaatccatcgggatagtcttttaaagcgctttcacagtccaactgatgcggatgcgactccggagtctggatcacggtcatctggaagaagaacgatgggaatcataatccgaaaacgggatcgggcgattgtgtctcatcaaacccacaagcagccgctgtctgcgtcgctccgtgcgactgctgtttatgggatcgggatccacagtgtcctgaagcatgattttaatagcccttaacattaactttctggtgcgatgcgcgcagcaacgcattcttatttcacttagattaatacagtaggtacagcacattatcacaatattgtttaataaaccataattaaaagcactccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcagcccaatataaccttccggaaccacactgccaacaccgctcccccagccatgcattgaagtgaaccctgctgattacaatgacaatgaagaatccaattctctcgaccgtgaatcacttgagaatgaaaaatatctatagtagcacaacatagacataaatgcatgcatcttctcataatttttaactcctcaggatttagaaacatatcccaaggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaaggatgatgtctggcgcatgatgtcgagcgtgcgcacaaccttgtcataatggagttgcttcctgacattctcgtattttgtatagcaaaacgcggccctggcagaacacactcttcttcgccttttatcctgccgcttagcgtgttccgtgtgatagttcaagtacagccacactcttaagttggtcaaaagaatgctggcttcagttgtaatcaaaactccatcacatctaatcgttctgaggaaatgatccacggtagcatatgcaaatcccaaccaagcaatgcaactggattgcgtttcaagcaggagaggagagggaagagacggaagaaccatgttaatttttattccaaacgatctcgcagtacttcaaattgtagatcgcgcagatggcatctgtcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacagtcctgcaccattcccagataattttcagctttccagccttggattattcgtgtcatttcttgtggtaaatccaatccacacattacaaacaggtcccggagggcgccctccaccaccattcttaaacacaccctcataatgacaaaatatcttgctcctgtgtcacctgtagcaaattgagaatggcaacatcaattgacatgccgttggctctaagttcttctctaagttctagttgtaaatactctttcatattatcaccaaactgcttagccagaagccccccgggaacaagagcaggacacgctacagtgcagtacaagcgcagacctccccaattggctccagcaaaaacaagattggaataagcatattgggaaccaccagtaatgtcatcaaagttgctggaaatataatcaggcagagtttgttgtaaaaattgaataaaagaaaaatttgccaaaaaaacattcaaaacctctgggatgcaaatgcaataagttaccgcgctgcgctccaacattgttagttttgaatgagtctgcaaaaaataaaaaaacaagcgtcatatcagagtagcctgacgaacaggtggataaatcagtctttccatcacaagacaagccacagggtctccagcccgaccctcgtaaaacctgtcatcgtgattaaacaacagcaccgaaagttcctcgcggtgaccagcatgaataattcttgatgaagcatacaatccaaacatgttagcatcagttaaagacaaaaaacagccaatatagcctctgggtataattatgcttaatcgtaaatatagcaaagccacccctcgcggatacaaagtaaaaggcacaggagaataaaaaatataattattcctttgctgctgttcaggcaacgtcgcccccggtccctctaaatacacatacaaagcctcatcagccatggcttaccagacaaagtacagcaggcacacaaagcacaagctctaaagtcactcaccaacctgtccacagtatatatacacaaaccctaaactgacgtaatggggctaaagtacacaaaatcccgccaaacccaacacacaccccgaaactgcgtcaccacaaaagtacagtttcacttccgcaatcccaacaagcggcacttcctctttctcacgggacgtcacatccgcttaacttgcaacctcattttcccacggccgcgccgccccttttagccgttaaccccacagccaattaccacacagcccacactttttaaaatcacctcatttacatattggcaccattccatctataaggtatattattgatgatggccaagctatttaggtgacactatagaatactcaagctatgcatcaagcttggtaccgagctcggatccactagtaacggccgccagtgtgctggaattcgcccttgtttaaacgcgatcg

SEQ ID NO: 11 - DNA, 35441 bp, Adenovirus B14b
  MISC_FEATURE (1)..(35441): Complete Genome
ctgcaggttaattaaggaagggcgaattctgcagatatccatcacactggcggccgctcgagcatgcatctagagggcccaattcgccctatagtgagtcgtattacaattcactggcccatcatcaataatataccttatagatggaatggtgccaatatgtaaatgaggtgattttaaaaagtgtgggctgtgtggtaattggctgtggggttaacggctaaaaggggcggcgcggccgtgggaaaatgacgttttttgggggtggagtgtttttgcaagttgtcgcggtaaatgtgacgcaaacaaaggctttttttttacggaactacttagtgttcccacggtatttaacaggaaatgaggtagttttggccggatgcaagtaaaaattgttcattttcgcgcgaaaactgaatgaggaagtggttttctgaataatgcggtatttatggcagggtggagtatttgttcagggccaggtagactttgacccattacgtggaggtttcgattaccgcggaggtttcgattaccgtgttttttacctaaatttccgcgtaccgtgtgaaagtcttctgtttttacgtaggtgtcagctgatcgctacggtatttatacctcagggtttgtgtcaagaggccactcttgagtgccagcgagaagagttttctcctctgcgccggcagtttaatattaaaaaaaatgagacacttgcgatttatgcctcaggaaataatttctgctgagactggaaacgaaatactggagtttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcgatactccaggggtgattgtggaaagcggtacaggtgtaagaaaattacctgatttgggttccgtggactgtgatttgcactgctatgaagacgggtttcctttgagtgatgaggaggaccatgaaaaggagcagtctatgcagactgcagcgggtgagggagtgaaggctgccattggttttcagttggattgcccggagcttcctggacatggctgtaagtcttgtgaatttcacaggaaaaatactggagtaaaggaactgttatgttcgctttgttatatgagagcgcactgccactttatttacagtaagtgtgtttaagttaaaatttaaaggaatatgctgtttttcacatgtatattgagtgggaaatttgtgcttcttattataggtcctgtgtctgatgctgatgagtcaccatctcctgattctactacctcacctcctgagattcaagcacctgttcctgtggacgtgcacaagcccattcctgtaaagcttaagcctggaaaacgtccagcagtggaaaaactcgaggacttgttacagggtggggacggacctttggacttgagtacacggaaacggccaagacaataagtgttccatatccgtgtttacttaaggtgacgtcaatatttgtgtgagagtgcaatgtaataaaaatatgttaactgtttactggtttttattgctttttgggcggggactcaggtatataagtagaagcagacctgtgtggttagctcatagaagctggctttgattcatggaggtttgggccattttggaagaccttagaaagactaggcaactgttagagaacgcttcggacggagtctccggtttttggagattctggttcgctagtgaattagctagggtagtttttaggataaaacaggactataaagaagaatttgaaaagttgttggtagattgtccaggactttttgaagctcttaatttgggccatcaagttcactttaaagaaaaagttttatcagttttagacttttcgaccccaggtagaactgccgctgctgtggcttttcttacttttatattagataaatggatcccgcagactcatttcagcaggggatacgttttggatttcgtagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaaaagggagagggcatctagtggtactgatgctagatctgagttggctttaagtttaatgagtcgcagacgtcctgaaaccatttggtggcatgaggtccagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactccagacaagacagttattagatgctgcatgatggatatgtggcctggagtagtcggtatggaagcagtaacttttgtaaatgttaagtttaggggagatggttataatggaatagtgtttatggccaataccaaacttatattgcatggttgtagcttttttggttttaacaatacctgtgtagatgcctggggacaggttagtgtacggggatgtagtttctatgcgtgttggattgccacagctggcagaaccaagagtcaattgtctctgaagaaatgcatattccaaagatgtaacctgggcattcttaatgaaggcgaagcaagggtccgccactgcgcttctacagatactggatgttttattttaattaagggcaatgccagcgtaaagcataacatgatttgcggtgcttccgatgagaggccttatcaaatgctcacttgtgccggagggcattgtaacatgctggctactgtgcatattgtttctcatcaacgcaaaaaatggcctgtttttgatcacaatgtgttgaccaagtgtaccatgcatgcaggtgggcgtagaggaatgtttatgccttaccagtgtaacatgaatcatgtaaaagtgttgttggaaccagatgccttttccagaatgagtctaacaggaatgtttgacatgaacatgcaaatctggaagatcctgaggtatgatgatacaagatcgagggtgcgcgcatgcgaatgcggaggcaagcatgccaggttccagccggtgtgtgtagatgtgactgaagatctgagaccggatcatttggttattgcccgcactggagcagagttcggatccagtggagaagaaactgactaaggtgagtattgggaaaactttggggtgggattttcagatggacagattgagtaaaaatttgtttttctgtcttgcagctgtcatgagtggaaacgcttcttttaatgggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagccgccgctgccgcctctgttgccgctaacactgtgcttggaatgggttactatggaagcatcctggctaattccacttcctctaataacccttctaccctgactcaggacaagttacttgtccttttggcccagctggaggctttgacccaacgtctgggtgaactttctcagcaggtggccgagttgcgagtacaaactgagtctgctgtcggcacggcaaagtctaaataaaaaaaaaaaattccagaatcaatgaataaataaacgagcttgttgttgatttaaaatcaagtgttttttatttcatttttcgcgcacggtatgccctagaccaccgatctcgatcattgagaacacggtggattttttccaaaatcctataaaggtgggattgaatgtttagatacatgggcattaggccgtctttggggtggagatagctccattgaagggattcatgctccggggtagtgttgtaaattacccagtcataacaaggtcgctgtgcatggtgttgcacaatatcttttagaagtaggctgattgccacagataagcccttggtgtaggtgtttacaaaccggttgagctgggaggggtgcattcggggtgaaattatgtgcattttggattggatttttaagttggcaatattgccgccaagatctcgtcttgggttcatgttatgaagtaccaccaagacggtgtatccggtacatttaggaaatttatcgtgcagcttggatggaaaagcgtggaaaaatttggagacacccttgtgtcctccgagattttccatgcactcatccatgataatagcaatagggccgtgggcagcagcgcgggcaaacacgttccgtgggtctgacacatcatagttatgttcctgagttaaatcatcataggccattttaataaatttgggacggagagtacccgattggggtatgaatgttccttcgggccccggagcatagttcccctcacagatttgcatttcccaagctttcagttccgagggtggaatcatgtccacctggggggctataaagaacaccgtttctggggctggggtaattagttgggatgatagcaagtttctgagcaattgagatttgccacatccggtggggccataaatgattccgattacaggttgcagttggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggttttagaccgtcagccatgggcattttggagagagtctgttgcaaaagttctagtctgttccacagttcagtgatgtgttctatggcatctcgatccagcagacctcctcgtttcgcgggtttggacggctcctggagtagggtatgagacgatgggcgtccagcgctgccagggttcggtccttccagggtctcaaagttcgggtcagggttgtttccgtcacagtgaaggggtgtgcgcctgcttgggcgcttgccagggtgcgcttcagactcatcctgctggtcgaaaacttgtgccgcttggcgccctgtatgtcggccaagtagcagtttaccatgagttcgtagttgagcgcctcggctgcgtggcccttggcgcggagcttacctttggaagttttcttgcataccgggcagtataggcatttcagcgcatacagcttgggcgcaaggaaaatggattctggggagtatgcatccgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttttccagtggagtgcctcggtcttcttcgtataggaactctgaccactctgatacaaaggcgcgcgtccaggccagcacaaaggaggctatgtgggaggggtagcgatcgttgtcaaccagggggtccaccttttccaaagtatgcaaacacatgtcactctcttcaacatccaggaatgtgattggcttgtaggtgtatttcacgtgacctggggtcccagctgggggggtataaaagggggcggttctctgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccgcttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcagcgatgttgagttggacatattcgcgtgccaggcacttccattcggggaagatagttgtcaattcatctggcacaattctcacttgccaccctcggttatgcaaggtaattaaatccacactggtggccacctcgcctcgaaggggttcgttggtccagcagagcctacctcctttcctagaacagaaaggtggaagtgggtctagcataagttcatcgggagggtctgcatccatggtaaagattccaggaagtaaatccttatcaaaatagctgatgggagtggggtcatctaaggccatttgccattctcgagctgccagtgcgcgctcatatgggttaaggggactgccccagggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgacggcgctagcagccccggacccaagttggtgcgattgggtttttctgttctgtagacaatctggcgaaagatggcgtgagaattggaagagatggtgggtctttgaaaaatgttgaagtgggcatgaggtagacctacagagtctctgataaagtgggcataagattcttcaagcttggttaccagttgggcggtgacaagtacgtccagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcgaaggtgtctctaaccatgactttgagaaattggtatttaaagtccatgtcgtcacaggctccctgttcccagagttggaagtctacccgtttcttgtaggcggggttgggcaaagcgaaagtaacatcgttgaagagaatcttaccggctctgggcataaaattgcgagtgatgcgaaaaggctgtggtacttccgctcgattgttgatcacctgggcagctaggacgatctcgtcgaagccgttgatgttgtgtcctacaatgtataattctatgaaacgcggcgtgcctctgacgtgaggtagcttattgagctcatcaaaggttaggtctgtagggtcagataaggcgtagtgttcaagggcccattcgtgcagatgaggatttgcatgtaggaatgatgaccaaagatccaccgccagtgctgtttgtaactggtcccgatactgacgaaaatgctggccaattgccattttttctggagtgacacagtagaaggttccgggatcttgttgccatcgatcccacttaagtttaatggctagatcgtgggccatgttgacgagacgctcttctcctgagagtttcatgaccagcatgaaaggaactagttgtttgccaaaggaccccatccaggtgtaagtttccacatcgtaggtcaggaagagtctttctgtgcgaggatgagagccgattgggaaaaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagctgtacctggcttcccttgacgagaaatttcagtgggaagccgaggcctggcgattgtatctcgtgctcttctatattcgctgtattggcctgttcatcttctgtttcgatggtggtcatgctgacgagcccccgcgggaggcaagtccagacctcggcgcgggaggggcggagctgaaggacgagagcgcgcaggctggagctgtccagagtcctgagacgctgcggactcaggttagtaggtagggacagaagattaacttgcatgatcttttccagggcgtgcgggaggtttagatggtacttgatttccacaggttcgtttgtagagacgtcaatggcttgcagggttccgtgtcctttgggtgccactaccgtacctttgttttttcttttgatcggtggtggctctcttgcttcttgcatgcttaaaagcggtgacggggacgcgcgccgggcggcagcggttgttccggacccgggggcatggctggtagtggcacgtcggcgccgcgcacgggcaggttctggtactgcgctctgagaagacttgcgtgcgccaccacgcgtcgattgacgtcttgtatctgacgtctttgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctctcgacggtggccgcgaggtcattggagatacggcccatgagttgggagaatgcattcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcgatgtgttcggcgacaaagaaatacatgatccatcgtctcagcggcatttcgctgacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccggcatctcttcttcctcttctatctcttcttccactaacatctcttcttcgtcttcaggcgggggcggagggggcacgcggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggaaagggcgctgattatacattttattaattggcccgtagggactgcgcgcagagatctaatcgtgtcaagatccacgggatctgaaaacctttcaacgaaagcgtctaaccagtcacagtcacaaggtaggctgagtacggcttcttgtgggcgggggtggttatgtgttcggtctgggtcttctattccttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagccagatctttgtagtagtcttgcatgagccgttctacgggcacttcttcttcacccgttctgccatgcatacgtgtgagtccaaacccgcgcattggttggaccagtgccaagtcagctacaactctttcggcgaggatggcttgctgtacttgggtgagggtggcttgaaagtcatcaaaatccacgaagcggtggtaagccccggtattgatggtgtaagcacagttggccatgactgaccagttaactgtttggtgaccatggcgcacgagctcggtgtatttaaggcgcgaataggcgcgggtgtcaaaaatgtaatcgttgcaggtgcgcaccagatactggtaccctataagaaaatgcggtggtggttggcggtagagaggccattgttctgtagctggagcgccgggggcgaggtcttccaacataaggcggtgatagccgtagatgtacctggacatccaggtgattcctgcggcggtagtggaagcccgaggaaactcgcgtacgcggttccaaatgttgcgtagcggcatgaagtagttcattgtaggcacggtttgaccagtgaggcgcgcgcagtcattgatgctctatagacacgaagaaaatgaaagcgttcagcgactcgactctgtagcctggaggaacgtgaacgggttgggtcgcggtgtaccccggttcaagacttgtactcgagccggccggagccgcggctaacgtggtattggcactcccgtctcgacccagcctacaaaaatccaggatacggaatcgagtcgttttgctggttgctgaatggcagggaagtgagtcctatttttttttttgccgctcagatgcatcccgtgctgcgacagatgcgtccccaacaacagcccccctcgcagcagcagcaaccacaaaaggctgtccctgcaactactgcaactgccgccgtgagcggtgcgggacagcccgcctatgatctggacttggaagagggcgaaggactggcacgtctaggtgcgccctcgcccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaagtgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttactcttggtttgatgcatttgtgggatttgatggaagctatcattcagaaccctactagcaaacctctgaccgcacagctgtttctggtggtgcaacacagcagagacaacgaggctttcagagaggcactgctcaacatcactgaacccgaggggagatggttgtatgatcttatcaacattctacagagtatcatagtgcaggagcggagcctgggcctggccgaaaaggtggctgccatcaattactcggttttaagtttgggaaaatattacgctcgcaagatctacaagactccatacgttcccatagacaaggaggtgaagatagatgggttctacatgcgtatgacgctcaaggtcttgaccctgagcgatgatcttggggtgtaccgcaatgacagaatgcatcgcgccgttagcgccagtaggaggcgcgagttaagcgacagggaactgatgcacagtttgcaaagagctctgactggagctggaacagagggtgagaattactttgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaacgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccattgtaaacgcgttggtggagaacaaagctattcgtccagatgaggccggactggtatacaacgctcttttagaacgcgtggctcgctacaacagtagcaatgtgcaaaccaatttggaccgtatgataacagatgtacgcgaagccgtgtctcagcgtgaaaggttccagcgcgatgccaaccttggttcgctggtggcgttaaatgcttttttgagtactcagcctgctaatgtgccgcgtggtcaacaggattatactaactttttgagtgcgttgagactgatggtatctgaagtacctcagagcgaagtgtatcagtccggacctgactacttctttcagactagcagacagggtttgcagacggtaaatctgagccaagcttttaaaaaccttaaaggtttgtggggagtgcatgccccggtaggagaaagagcaaccgtgtctagcttgttaactccaaactcccgcctattactactgttggtagctcctttcaccgacagcggcagcatcgaccgtaattcctatttgggttacctactaaacctgtatcgcgaagccatagggcaaagccaggtggacgagcagacctatcaagaaattacccaagtcagtcgcgctttgggtcaggaagacactggcagtttggaagccactctgaacttcttgcttaccaatcggtctcagaagatccctcctcaatatgctcttactgcggaggaggagaggatccttagatatgtgcagcagagcgtgggattgtttctgatgcaagagggggcaactccgactgcggcattggacatgacagcgcgaaatatggagcccagcatgtatgccagtaaccggcctttcattaacaaactgctggactacttgcacagagctgccgctatgaactctgattattttaccaatgccatcctaaacccgcactggctgcccccacctggtttctacacgggcgaatatgacatgcccgaccctaatgacgggtttctgtgggacgacgtggacagtaatgttttttcacctctttttgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggaatacctaaacgattccttgctcagaccggcgagagaaaaaaatttcccaaacaatggaatagaaagtttggtggataagatgagtagatggaagacttatgctcaggatcacagagacgagcctgggatcatggggactacaagtagagcgagccgtagacgccagcgtcatgacagacagaggggtcttgtgtgggaagatgaggattcggccgatgatagcagcgtgttggacttgggtgggagaggaaggggcaacccgtttgctcatttgcgccctcgcttgggtggtatgttgtaaaaaaaaaataaaaaggaaaactcaccaaggccatggcgacgagcgtacgttcgttcttctttattatttgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtacctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcagaacaatgactttacccctacggaagccagtacccagaccattaactttgatgaacgatcgcggtggggcggtcagctaaagaccatcatgcatactaacatgcccaacgtaaacgagtatatgtttagtaacaacttcaaagcgcgtgtgatggtgtccagaaaacctcccgaaggtgctgcagttggggatacatatgatcacaagcaggatattttggaatatgagtggttcgagtttactttgccagaaggcaacttttcagttactatgaccattgatttgatgaacaatgccatcatagataactacttgaaagtgggcagacagaatggagtgcttgaaagtgacattggtgttaagttcgacaccaggaacttcaagctgggatgggatcccgaaaccaagttgattatgcctggagtgtatacgtatgaagcctttcatcctgacattgtcttactgcctggctgtggagtggactttaccgaaagtcgtttgagcaaccttcttggtatcagaaaaaaacagccatttcaagagggttttaagattttgtatgaagatttagaaggaggtaatattccggccctcttggatgtagatgcctatgagaacagtaagaaagaacaaaaagccaaaatagaagctgctgcggaagctaaggcaaacatagttgccagcgactctacaagggttgctaacgctggagaggtcagaggagacaattttgcaccaacacctgttccgactgcagaatcattattggccgatgtaactggaggaacggacgtgaaactcactattcaacctgtagaaaaagatagtaagaatagaagctataatgtgttggaagataaaatcaacacagcctatcgcagttggtacctttcgtacaattatggcgatcccgaaaaaggagtgcgttcctggacattgctcaccacctcagatgtcacctgcggagcagagcaggtctactggtcgcttccagacatgatgcaggatcctgtcactttccgctccactagacaagtcagcaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaatgtccattcttatctcgcccagtaataacaccggttggggtctgcgcgctccaagcaagatgtacggaggcgcacgcaaacgttctacccaacatcccgtgcgtgttcgcggtcattttcgcgctccatggggtgccctcaagggccgcactcgcgttcgaaccaccgtcgatgatgtaatcgatgaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtgggacgaagagccatgcttagggcggccagacgtgcagcttcgggcgccagcgccggcaggtcccgcaggcaagcagccgctgtcgcagcggcgactattgccgacatggcccaaacgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgctgaaggatgaaaaaaaaccccgcaaaatcaagcgggctaaaaaggacaaaaaagaagaggaagatggcgatgatgggctggcggagtttgtgcgcgagtttgccccacggcgacgcgtgcaatggcgtggacgcaaagttcgacatttgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataaatcccaaggatgagacagtgtccatacccttggatcatggaaatcccacccctagtcttaaaccggtcactttgcagcaagtgttacccgtaactccgcgaacaggtgttaaacgcgaaggtgaagatttgtatcccactatgcaactaatggtacccaaacgccaaaagttggaggacgttttggagaaagtaaaagtggatccagatattcaacctgaggttaaagtgagacccattaagcaggtagcgcctggtctgggagtacaaactgtagacattaagattcccactgaaagtatggaagtgcaaactgaacccgcaaagcctactgccacctccactgaagtgcaaacggatccatggatgccgatgcctattacaactgacgccgccggtcccactcgaagatcccgacgaaagtacggtccagcaagtctgttgatgcccaactatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatagtagtgcggaacctttgacactgccgcgtgcgcgttaccatccaagtatcatcacttaatcaatgttgccgctgcctccttgcagatatggccctcacttgtcgccttcgcgttcccatcactggttaccgaggaagaaattcgcgccgtagaagagggatgttggggcgcggaatgcgacgctacaggcgacggcgtgctatccgcaagcaattgcggggtggttttttgccagccttaattccaattatcgctgctgcaattggcgcgataccaggcatagcttccgtggcggttcaggcctcgcaacgacattgacattggaaaaaaaagtataaataaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaactttcaacaaaaagtagtcgatgggatagcttccggcatcaatggagtggtagatttggctaatcaggctgtgcagaaaaagataaacagtcgtttggacccgccgccagcaaccccaggtgaaatacaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagcccctatggctaccggggtaatgaaaccttctcagttgcatcgacccgtcactttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccagtgggcatacatgcacatcgccggacaggatgcttcggagtacctgagtccgggtctggtgcagttcgcccgcgccacagacacctacttcaatctgggaaataagtttagaaatcccaccgtagcgccaacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagtttcaaaccctattctggtacggcttacaactctctggctcctaaaggcgctccaaatgcatctcagtggttggataaaggggttgaaactactgaagaacggcaaaatgaagacggggaaaatgacgaaaaagctacatacacttttggcaatgccccagtaaaagccgatgctgacattacaaaagacggactaccaataggtttggaagtcccagctgaaggtgaccctaaacctatctacgctaataagctttaccaaccagaaccccaggtgggacaggaatcgtggactgatacagatggcactgaagaaaaatacggaggcagagtacttaaaccggacactaaaatgaaaccgtgctatgggtcttttgctaaacctactaatgtgaaaggcggacaggcaaaagtgaaaacagaagaaggcaacaacattgaatatgacattgacatgaacttttttgacttaagatcacaaaaacaaggtcttaaacctaagattgtaatgtatgcagaaaatgtggacctggaatctccagatactcatgttgtgtacaaacctgaagtttcagatgctagttcaaatgctaatcttggacagcagtctatgcccaacagacccaactacattggcttcagagataattttattggtcttatgtactataacagtactggtaacatgggggtgctggctggccaagcatctcagttgaatgcagtggttgacttgcaggacagaaacacagaactgtcttaccaactcttgcttgactccctgggcgatagaaccagatactttagcatgtggaatcaggctgttgacagttatgatcccgatgtgcgtgttattgaaaatcatggtgtggaagatgaacttcccaactactgttttccactggacggcatcggtccgcgaacagatagttacaaggagattcagttaaatggagaccaagcttggaaagatgtaaatccaaatggtatcagtgaacttgttaagggaaatccatttgccatggaaattaaccttcaagccaatctatggcgaagtttcctttattccaatgtggctctgtatctcccagactcgtacaaatacaccccgtccaatgtcactcttccagaaaacaaaaacacctacgactacatgaacgggcgggtggtgccgccatctctagtagacacctatgtgaacattggcgccaggtggtctctggatgctatggacaatgtcaacccattcaaccaccaccgtaacgctggcttgcgttaccgatccatgcttttgggtaacggacgttatgtgcctttccacatacaagtgcctcaaaaattcttcgctgtcaaaaacctgctgcttctcccaggctcctacacttatgagtggaacttcaggaaggatgtgaacatggtgctacagagttccctcggtaacgacctacgggtagatggcgccagcatcagtttcacgagcatcaacctctatgctacctttttccccatggctcacaacaccgcttccacccttgaagccatgctgcggaatgacaccaatgatcagtcattcaacgactatctatctgcagctaacatgctctatcccattcctgccaatgcaaccaatattcccatttccattccttctcgcaactgggcggctttcagaggctggtcatttaccagactcaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcccaacgaatttgaaataaagcgcactgtggatggcgaaggctacaatgtagcccaatgcaacatgaccaaagactggttcttggtacagatgctcgccaactacaacataggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaacatgctttatgccaactcagctcatgctctggacatgacctttgaggtggatcccatggatgagcccaccctgctttatcttctcttcgaagttttcgacgtggtcagagtgcatcagccacatcgcggcatcatcgagacagtctacctgcgtacaccgttctcggccggtaacgctaccacgtaaaaagcttcttgcttcttgcaaacagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaacacggccggacgtgagacggggggagagcactggttggctttcggttggaacccacgttctaacacctgctacctttttgatccttttggattctcggatgatcgtcttaaacagatttaccagtttgaatatgagggtctcctgcgccgcagcgctcttgctaccaaggaccgctgtattacgctggaaaaatctacccagaccgtgcagggcccccgttctgccgcctgcggacttttctgctgcatgttccttcatgcctttgtgcactggcctgaccgtcccatggacggaaaccccaccatgaaattgctgactggagtgccaaacaacatgcttcattctcctaaagtccagcccaccctgtgtgacaatcaaaaagcactctaccattttctcaatacccattcgccttattttcgctcccatcgtacacacatcgaaagggccactgcgttcgaccgtatggatgtgcaataatgactcatgtaaacaacgtgttgaataaacagcactttattttttacacgtatcaaggctctggattacttatttatttacaagtcgaatgggttctgacgagaatcagaatgacccgcgggcagtgatacgttgcggaactgatacttgggttgccacttgaattcgggaatcaccaacttgggaaccggtatatcgggtaggatgtcactccacagctttctggtcagctgcaaagctcccagcaggtcaggagccgaaatcttgaaatcacaattaggaccagtgctctgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggattagtatcatcttggcctgatcctgtctgattcctggatacacggctctcatgaaagcatcatattgcttgaaagcctgctgggctttactaccctcggtatagaacatcccgcaggacctgctcgaaaactggttagctgcgcagccggcatcattcacacagcagcgggcgtcattgttggctatttgcaccacacttctgccccagcggttttgggtgattttggttcgctcgggattctccttcaaggctcgttgtccattctcgctggccacatccatctcgataatctgctccttctgaatcataatagtgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgctgctcaggcattagtttaaaagaggttctaagttcgttatccagcctgtacttctccatcagtacacacatcacttccatgcccttctcccaagcagacaccaggggcaagctaatcggattcttaacagtacaggcagcagctcctttagccagaggatcatctttggcaatcttttcaatgcttcttttgccatccttctcaacgatgcgcacgggcgggtagctgaaacctactgctacaagctgcgcctcttctctttcttcttcgctgtcttgactgatgtcttgcatgggaacatgtttggtcttccttggcttctttttggggggtatcgggggaggaggactgtcgctccgttccggagacagggaggattgtgaagtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacaagtgccatcacatctcgtcgtcagcgacgaggaaaaggagcagagcttaaccattccaccgcccagtcctgccaccacctctaccctagaagataaggaggtcgacgcatctcatgacatgcagaataaaaaagcgaaagagtctgaaacagacatcgagcaagacccgggctatgtgacaccggtggaacacgaggaagagttgaaacgctttctagagagagaggatgaaaactgcccaaaacagcaagcggataactatcaccaagatgctggaaatagggatcagaacaccgactacctcatagggcttgacggggaagacgcgctccttaaacatctagcaagacagtcactcatagtcaaggatgcattattggacagaactgaagtgcccatcagtgtggaagagctcagccgcgcctacgagcttaaccttttttcacctcgtactccccccaaacgccagccaaacggcacctgcgagccaaatcctcgcttaaacttttatccagcttttgctgtgccagaagtactcgctacttatcacatcttttttaaaaatcaaaaaattccagtctcctgccgcgctaatcgcacccgcgctgacgccctacttaatctgggacctggttcacgcttacctgatatagcttccttggaagaggttccaaaaatcttcgagggtctgggcaataatgagactcgggccgcaaatgctctgcaaaagggagaaaatggcatggatgagcatcacagcgttctggtggaattggagggcgataatgccagactcgcagtactcaagcgaagcgtcgaggtcacacactttgcataccccgctgtcaacctgccccctaaagttatgacggcggtcatggaccagttactcattaagcgcgcaagtcccctttcagaagacatgcatgacccagacgcctgtgatgagggtaaaccagtggtcagtgatgagcagctaacccgatggctggacaccgactctccccgggatttggaagagcgtcgcaagcttatgatggccgtagtgctggttaccgtagaactagagtgtctccggcgtttctttaccgattcagaaaccttgcgcaaactcgaagagaatctgcactacacttttagacacggctttgtgcggcaggcgtgcaagatatctaacgtggaactcaccaacctggtttcctacatgggtattctgcatgagaatcgtctaggacaaagcgtgctgcacagcacccttaagggggaagcccgccgtgattacatccgcgattgtgtctatctctacctgtgccacacgtggcaaaccggcatgggtgtatggcagcaatgtttagaagaacagaacttgaaagagcttaacaagctcttacagaaatctcttaaggttctgtggacagggttcgacgagcgcaccgtcgcttccgacctggcagacctcatcttcccagagcgtcttagggttactttgcgaaacggactgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactacctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaactgcaaggccccagcagccaaggcgatgggtcttctcctgggcaaagtttaaaactgaccccgggactgtggacctctgcctacttgcgcaagtttgccccggaagattaccacccctatgaaatcaagttctatgaggaccaatcacagcctccaaaggccgaactttcggcctgcgtcatcacccagggggcaattctagcccaattgcaagccatccaaaaatcccgccaagaatttctactgaaaaagggtaagggggtctaccttgacccccagaccggcgaggaactcaacacaaggttccctcaggatgtcccaacgacgagaaagcaagaagttgaaggtgcagccgccgcccccagaagatatggaggaagattgggacagtcaggcagaggaagcggaggaggacagtctggaggacagtctggaggaagacagtttggaggaggaaaacgaggaggcagaggaggtggaagaagtaaccgccgacaaacagttatccccggctgcggagacaagcaacagcgctatcatctccgctccgagtcgaggaacgcggcggcgtcccagcagtagatgggacgagaccggacgcttcccgaacccaaccaccgcttccaagaccggtaagaaggatcggcagggatacaagtcctggcgggggcataagaatgccatcatctcctgcttgcatgagtgcgggggaaacatatccttcacgcgacgctacttgctattccaccatggggtgaactttccacgcaatgttttgcattactaccgtcacctccacagcccctactatagccagcaaatcccggcaatctcgacagaaaaagacagcggcggcgacctccaacagaaaaccagcagcggcagttaaaaaatacacaacaagtgcagcaacaggaggattaaagattacagccaacgagccagcgcaaacccgagagctaagaaatcggatctttccaaccctgtatgccatcttccagcagagtcggggccaagagcaggaactgaaaataaaaaaccgatctttgcgttcgctcaccagaagttgtttgtatcacaagagcgaagatcaacttcagcgcactcttgaggacgccgaggctctcttcaacaagtactgcgcgctgactcttaaagagtaggcagcgaccgcgcttattcaaaaaaggcgggaattacatcatcctcgtcatgagtaaagaaattcccacgccttacatgtggagttatcagccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtataccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgattagaggccgaggtattcagcttaacgacgagtcggtgagctctccgcttggtctacgaccagacggaatctttcaaattgccggctgcgggagatcttccttcacccctcgtcagactgttttgactttggaaagttcgtcttcgcaaccccgctcgggcggaatcgggaccgttcaatttgtggaggagtttactccctctgtctacttcaaccctttctccggatctcctgggcactacccggacgagttcataccgaactttgacgcaattagcgagtcagtggacggctacgattgatgtctggtgacgcggctgagctatctcggctgcgacatctagaccactgccgccgctttcgctgttttgcccgggaactcattgagttcatttacttcgaactccccaaggatcaccctcaaggtccggcccacggagtgcggattactatcgaaggtaaaataaactctcgcctgcatcgaattttctcccagcggcccgtgctgatcgagcgagaccagggaaacaccacggtttctatctactgcatttgtaatcacccaggattgcatgaaagcctttgctgtcttatgtgtactgagtttaataaaaactgaattaagactctcctacggactgccgcttcttcaacccggattttacaaccagaagaacgaaacttttcctctcatccaggactctgttaactttacctttcctacttacaaaccagaagctcaacgacaacaccgcttttccagaagcattttccctactaatactactttcaaaaccggaggtgagctccacagtctccccgcagaaaacccttgggtggaagcgggccttgtagtgctaggaattcttgcgggcgggcttgtgattattctttgctacctatacacaccttgcttcactttcctagtggtgttgtggtattggtttaaaaaatggggcccatactagtcttgcttgttttactttcgcttttgggaccgggttctgccaactacaatccatgtctagactttgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacacttttattttttctacaatgtgcgatctggccatgttcatgagcaaacagtattctctatggcctcccagcaaggacaacattgtaacgttctccattgcttattgcttgtgcgcttgccttcttactgctttactgtgcgtatgcatacacctgcttgtaaccactcgtatcaaaaacgccaataacaaagaaaaaatgccttaacctctttctgtttacagacatggcttttcttacagctctcatacttgtcagcattgtcactgccgctcacggacaaacagtcgtctctatccctctaggtcataattacactctcataggacccccaatcacttcagaggtcatctggaccaaactgggaagcgttgattactttgatataatctgtaacaaaacaaaaccaataatagtaacctgcaacatacaaaatcttacattaattaatgttagcaaagtttacagcggttactattatggttatgacagatacagtagtcaatatagaaattacttggttcgtgttacccagtccaaaaccacgaaaatgccaaatatggcagaaattcgatccgatgacaattctctagaaacttttacatcttccaccacacctgacgaaaaaaatatcccagattcaatgattgcaattatcgcagcggtggcagtggtgatggcactaacagtaatatgcatgcttttatatgcttgtcgctacaaaaagtttcatcctaaaaaacaagatctcctactaaggcttaacatttaatttctttttacacagccatggtttccactaccacattccttatgcttactagtatagcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatccaccactccagcgccccgcaaaactactttctctagcagcagtgccgctaacaatacaatttccaatccaacctttaccgcgcttttaaaacgcactgtgaataattctacaacaatttccacttcaacaatcagcatcatcgctgccgtgacaattggaatatctattcttgtttttaccataacctactacacctgctgctataaaaaagacgaacataaaggtgatccattacttagatttgatatttaatttgttctttttttttttatttacagtatggtgaacaccaatcatggtacctagaaatttcttcttcaccatactcatctgtgcttttaatgtttgcgctactttcacagcagtagccacagcaagcccagactgtataggagcatttgcttcctatgcactttttgcttttgtcacttgcatctgcgtatgtagcatagtctgcctggttattaattttttccaacttctagactggatccttgtgcgaattgcctacctgcgccaccatcccgaataccgcaaccaaaatatcgcggcacttcttagacttatctaaaaccatgcaggctatactaccaatatttttgcttctattgcttccctacgctgtctcaaccccagctacctatagtactccaccagaacaccttagaaaatgcaaattccaacaaccgtggtcatttcttgcttgctatcgagaaaaatctgaaattcccccaactttaataatgattgctggaataattaatgtaatctgttgcaccataatttcatttctgatataccccctatttgattttggctggaatgctcccaatgcacatgattattcccaagacccagaggaacacattcccctacataacatgcaacaaccaatagcgctaatagaatacgaaagtgaaccacaacccccactactccctgctattagttacttcaacctaaccggcggagatgactgaaacactcaccacctccaattccgccgaggatctgcttgatatggacggccgcgtctcagaacagcgactcgcccaactacgcatccgccagcagcaggaacgcgtggccaaagagctcagagatgtcatccaaattcaccaatgcaaaaaaggcatattctgtttggtaaaacaagccaaaatatcctacgagatcaccgctaccgaccatcgcctctcttacgagcttggcccccaacgacaaaaatttacctgcatggtgggaatcaaccccatagttatcacccaacaaagtggagatactaagggttgcattcactgctcctgcgattccatcgagtgcacctacaccctgctgaagaccctatgcggactaagagacctgctacccatgaattaaaaaaatgattaataaaaaatcacttacttaaaatcagcaataaggtctctattgaaattttctcccagcagcacctcacttccctcttcccaactctggtattctaaaccccgttcagcggcatactttctccatactttaaaggggatgtcaaattttagctcctctcctgtacccacaatcttcatctctttcttcccagatgaccaagagagtccggctcagtgactccttcaaccctgtctacccctatgaagatgaaagcacctcccaacacccctttataaacccagggtttatttccccaaatggcttcacccaaagcccagacggagttcttactttaaaatgtttaaccccgctaacaaccacaggcgggtctctacagctaaaagtgggagggggacttacagtagatgacactgatgggaccttacaagaaaacataggtgccaccacaccacttgttaagactgggcactctataggtttatccctaggagccggattgggaacagatgaaaataaactttgtaccaaattgggagaaggacttacattcaattcaaacaacatttgcattgatgacaatattaacaccctgtggacaggagttaaccccaccgaagccaactgtcaaatgatggactccagtgaatctaatgattgcaaattaattctaacactagttaaaactggagccctagtcactgcatttgtttatgttataggagtatctaacaattttaatatgctaactacatacagaaatataaattttactgcggagctgttttttgattctgcgggtaatttactaactagcctgtcatccctaaaaactccacttaatcataaatcaggacaaaacatggctactggtgccattactaatgctaaaagtttcatgcccagcacaactgcttatcctttcaataataattctagagaaaaagaaaactacatttacggaacttgtcactacacagctagtgatcacactgcttttcccattgacatatctgtcatgcttaaccaaagagcaataagagctgatacatcatattgtattcgtataacttggtcctggaacacaggagatgccccagaggggcaaacctctgctacaaccctagttacctccccatttaccttttactacatcagagaagacgactgacaaataaagtttaacttgtttatttgaaaatcaattcacaaactccgagtagttattttgcctcccccttcccatttaacagaatataccaatctctccccacgcacagctttaaacatttggataccattagagatagacatggttttagattccacattccaaacagtttcagagcgagccaatctggggtcagtgatagataaaaatccatcgggatagtcttttaaagcgctttcacagtccaactgatgcggatgcgactccggagtctggatcacggtcatctggaagaagaacgatgggaatcataatccgaaaacgggatcgggcgattgtgtctcatcaaacccacaagcagccgctgtctgcgtcgctccgtgcgactgctgtttatgggatcgggatccacagtgtcctgaagcatgattttaatagcccttaacattaactttctggtgcgatgcgcgcagcaacgcattcttatttcacttagattaatacagtaggtacagcacattatcacaatattgtttaataaaccataattaaaagcactccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcagcccaatataaccttccggaaccacactgccaacaccgctcccccagccatgcattgaagtgaaccctgctgattacaatgacaatgaagaatccaattctctcgaccgtgaatcacttgagaatgaaaaatatctatagtagcacaacatagacataaatgcatgcatcttctcataatttttaactcctcaggatttagaaacatatcccaaggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaaggatgatgtctggcgcatgatgtcgagcgtgcgcacaaccttgtcataatggagttgcttcctgacattctcgtattttgtatagcaaaacgcggccctggcagaacacactcttcttcgccttttatcctgccgcttagcgtgttccgtgtgatagttcaagtacagccacactcttaagttggtcaaaagaatgctggcttcagttgtaatcaaaactccatcacatctaatcgttctgaggaaatgatccacggtagcatatgcaaatcccaaccaagcaatgcaactggattgcgtttcaagcaggagaggagagggaagagacggaagaaccatgttaatttttattccaaacgatctcgcagtacttcaaattgtagatcgcgcagatggcatctgtcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacagtcctgcaccattcccagataattttcagctttccagccttggattattcgtgtcatttcttgtggtaaatccaatccacacattacaaacaggtcccggagggcgccctccaccaccattcttaaacacaccctcataatgacaaaatatcttgctcctgtgtcacctgtagcaaattgagaatggcaacatcaattgacatgccgttggctctaagttcttctctaagttctagttgtaaatactctttcatattatcaccaaactgcttagccagaagccccccgggaacaagagcaggacacgctacagtgcagtacaagcgcagacctccccaattggctccagcaaaaacaagattggaataagcatattgggaaccaccagtaatgtcatcaaagttgctggaaatataatcaggcagagtttgttgtaaaaattgaataaaagaaaaatttgccaaaaaaacattcaaaacctctgggatgcaaatgcaataagttaccgcgctgcgctccaacattgttagttttgaatgagtctgcaaaaaataaaaaaacaagcgtcatatcagagtagcctgacgaacaggtggataaatcagtctttccatcacaagacaagccacagggtctccagcccgaccctcgtaaaacctgtcatcgtgattaaacaacagcaccgaaagttcctcgcggtgaccagcatgaataattcttgatgaagcatacaatccaaacatgttagcatcagttaaagacaaaaaacagccaatatagcctctgggtataattatgcttaatcgtaaatatagcaaagccacccctcgcggatacaaagtaaaaggcacaggagaataaaaaatataattattcctttgctgctgttcaggcaacgtcgcccccggtccctctaaatacacatacaaagcctcatcagccatggcttaccagacaaagtacagcaggcacacaaagcacaagctctaaagtcactcaccaacctgtccacagtatatatacacaaaccctaaactgacgtaatggggctaaagtacacaaaatcccgccaaacccaacacacaccccgaaactgcgtcaccacaaaagtacagtttcacttccgcaatcccaacaagcggcacttcctctttctcacgggacgtcacatccgcttaacttgcaacctcattttcccacggccgcgccgccccttttagccgttaaccccacagccaattaccacacagcccacactttttaaaatcacctcatttacatattggcaccattccatctataaggtatattattgatcggtaaaaaagccattcacagcttcctcattagaatcctccgatccctctacctctaaatcatacagttcctgaagcgtaggaggctcaaaaagctgcacaggtggctccggatcgtctcccatcagggcgtgcaccacaaactccagtatttcgtttccagtctcagcagaaattatttcctgaggcataaatcgcaagtgtctcattttttttaatattaaactgccggcgcagaggagaaaactcttctcgctggcactcaagagtggcctcttgacacaaaccctgaggtataaataccgtagcgatcagctgacacctacgtaaaaacagaagactttcacacggtacgcggaaatttaggtaaaaaacacggtaatcgaaacctccgcggtaatcgaaacctccacgtaatgggtcaaagtctacctggccctgaacaaatactccaccctgccataaataccgcattattcagaaaaccacttcctcattcagttttcgcgcgaaaatgaacaatttttacttgcatccggccaaaactacctcatttcctgtta

SEQ ID NO: 12 - DNA, 35153 bp, Adenovirus B34
  MISC_FEATURE (1)..(35153): Complete Genome
aattgctgatttgcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctacggtatttatacctcagggtttgtgtcaagaggccactcttgagtgccagcgagaacatcatcaataatataccttatagatggaatggtgccaatatgtaaatgaggtgattttaaaaattgtggggtgtgtggtgattggctgtggggttaacggctaaacggggcggcgcggccgtgggaaaatgacgttttgtgggggtggagtttttttgcaagttgtcgcgggaaatgtgacgcataaaaaggctttttttctcacggaactactgacttttcccacggtatttaacaggaaatgaggtagttttgaccggatgcaagtgaaaattgctgatttgcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctacggtatttatacctcagggtttgtgtcaagaggccactcttgagtgccagcgagaagagttttctcctctgcgccggcagtttaataataaaaaaatgagagatttgcgatttctgcctcaggaaataatttctgctgagactggaaatgaaatactggagcttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcgatactccaggggtgattgtggaaagcggtacaggtgtaagaaaattacctgatttgggttccgtggactgtgatttgcactgctatgaagacgggtttcctccgagtgatgaggaggaccatgaaaaggagcagtctatgcagactgcagcgggtgagggagtgaaggctgccagtgttggttttcagttggattgcccggagcttcctggacatggctgtaagtcttgtgaatttcacaggaaaaatactggagtaaaggaactgttatgttcgctttgttatatgagagcgcactgccactttatttacagtaagtgtgtttaagttaaaatttaaaggaatatgctgtttttcacatgtatattgagtgggagttttgtgcttcttattataggtcctgtgtctgatgctgatgagtcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacggccaagacaataagtgttccatatccgtgtttacttaaggtgacgtcaatatttgtgtgagagtgcaatgtaataaaaatatgttaactgttcactggtttttattgctttttgggcggggactcaggtatataagtagaagcagacctgtatggttagctcataggagctggctttcatccatggaggtttgggccattttggaagaccttagaaagactaggcaactgttagaggacgcttcggacggagtctccggtttttggagattctggttcgctagtgaattagctagggtagtttttaggataaaacaggactataaagaagaatttgaaaagttgttggtagattgcccaggactttttgaagctcttaatttgggccatcaagttcactttaaagaaaaagttttatcagttttagacttttcaaccccaggtagaactgccgctgctgtggcttttcttacttttatattagataaatggatcccgcagactcatttcagcaggggatacgttttggatttcgtagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggtccagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggagtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatattccaaagatgtaacctgggcattctgaatgaaggcgaagcaagggtccgccactgcgcttctacagatactggatgttttattttaattaagggcaatgccagcgtaaagcataacatgatttgcggtgcttccgatgagaggccttatcaaatgctcacttgtgccggtgggcattgtaatatgctggctactgtgcatattgtttcccatcaacgcaaaaaatggcctgtttttgatcacaatgtgttgaccaagtgtaccatgcatgcaggtgggcgtagaggaatgtttatgccttaccagtgtaacatgaatcatgtgaaagtgttgttggaaccagatgccttttccagaatgagcctaacaggaatctttgacatgaacatgcaaatctggaagatcctgaggtatgatgatacgagatcgagggtgcgcgcatgcgaatgcggaggcaagcatgccaggttccagccggtgtgtgtagatgtgactgaagatctgagaccggatcatttggttattgcccgcactggagcagagttcggatccagtggagaagaaactgactaaggtgagtattgggaaaacttggggtggggttttcagatggacagattgagtaaaaatttgttttttctgtctttcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagccgccgccgccgcctctgttgccgctaacactgtgcttggaatgggttactatggaagtatcgtggctaattccacttcctctaataacccttctaccctgactcaggacaagttacttgtccttttggcccagctggaggctttgacccaacgtctgggtgaactttatcagcaggtggccgagttgcgagtacaaactgagtctgctgtcggcacggcaaagtctaaataaaaaaaaattccacaatcaatgaataaataaacgagcttgttgttgatttaaaatcaagtgtttttatttcatttttcgcgcacggtatgccctagaccaccgatctcgatcattgagaacacggtggattttttccagaatcctatagaggtgggattgaatgtttagatacatgggcattaggccatctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggaggggtgcattcggggtgaaattatgtgcattttggattggatttttaagttggcaatattgccgccaagatctcgtcttgggttcatgttatgaaggaccaccaagacggtgtatccggtacatttaggaaatttatcgtgtagcttggatggaaaagcgtggaaaaatttggagacacccttgtgtcctccgagattttccatgcactcatccatgataatagcaatggggccgtgggcagcagcgcgggcaaacacgttccgtgggtctgacacatcatagttatgttcctgagttaaatcatcataagccattttaatgaatttggggcggagagtacccgattggggtatgaatgttccttcgggccccggagcatagttcccctcacagatttgcatttcccaagctttcagttccgatggtggaatcatgtccacctggggggctatgaagaacaccgtttctggggcgggggtgattagttgggatgatagcaagtttctgagcaattgagatttgccacatccggtggggccataaatgattccgattacaggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggttttagaccgtcagccatgggcattttggagagagtttgctgcaaaagttctagtctgttccacagttcagtgatgtgttctatggcatctcgatccagcagacctcctcgtttcgcgggtttggacggctcctggagtagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcattctgctggtggagaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacagcttgggcgcaaggaaaatggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtatccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcagcgatgttgagttggacatactcgcgtgctaggcacttccattcggggaagatagttgtcaattcatctggcacgattctcacttgccaccctcgattatgcaaggtaattaaatccacactggtggccacctcgcctcgaaggggttcgttggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcacgctcatatgggttaaggggactgccccagggcatgggatgggtgagtgcagaggcatacatgccacagatgtcatagacgtagatgggatcctcaaagatgcctatataggttggatagcatcgcccccctctgatacttgctcgcacatagtcatatagttcatgtgatggcgctagcaaccccggacccaagttggtgcgattgggtttttctgttctgtagacaatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgcagcgaagcgtgagtaagggcgaaggtgtctctgaccatgactttgagaaattggtatttgaagtccatgtcgtcacaggctccctgttcccagagttggaagtctacccgtttcttgtaggcggggttgggcaaagcgaaagtaacatcgttgaagagaatcttaccggctctgggcataaaattgcgagtgatgcggaaaggctgtggtacttccgctcgattgttgatcacctgggcagctaggacgatctcgtcgaaaccgttgatgttgtgtcctacgatgtataattctatgaaacgcggcgtgcctttgacgtgaggtagcttattgagctcatcaaaggttaggtctgtagggtcagataaggcgtagtgttcgagagcccattcgtgcaggtgaggatttgcatgtaggaatgatgaccaaagatccaccgccagtgctgtttgtaactggtcccgatactgacgaaaatgctggccaattgccattttttctggagtgacacagtagaaggttctggggtcttgttgccatcgatcccactttagtttaatggctagatcgtgggccatgttgacgagacgctcttctcctgagagtttcatgaccagcatgaaaggaactagttgtttgccaaaggaccccatccaggtgtaagtttccacatcgtaggtcaggaagagtctttctgtgcgaggatgagagccgatcgggaagaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagctgtacctggcttcccttgacgagaaatttcagtgggaagccgaggcctggcgattgtatctcgtgctcttctatattcgctgtatcggcctgttcatcttctgtttcggtggtggtcatgctgacgagcccccgcgggaggcaagtccagacctcggcgcgggaggggcggagctgaaggaccagagcgcgcaggctggagctgtccagagtcctgagacgctgcggactcaggttagtaggtagggacagaagattaacttgcatgatcttttccagggcgtgcgggaggttcagatggtacttgatttccacaggttcgtttgtagagatgtcaatggcttgcagggttccgtgtcctttgggcgccactaccgtacctttgttttttcttttgatcggtggtggctctcttgcttcttgcatgctcagaagcgatgacggggacgcgcgccgggcggaagcggttgttccggacccggaggcatggctggtagtggcacgtcggcgccgcgcacgggcaggttctggtactgcgctctgagaagacttgcgtgcgccaccacgcgtcgattgacgtcttgtatctgacgtctctgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctctcgacggtggccgcgaggtcattggagatacggcccatgagttgggagaatgcagtcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcaatgtgttcggcgacgaagaaatacatgatccatcgtctcagcggcatttcgctgacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccgggatctcttcttcctcttctatctcttcttccactaacatctcttcttcgtcttcaggcgggggcggagggggcacacggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcgcgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaacccgcgcattggttgtaccagtgccaagtcagctacgactctttcggcgaggatggcttgctgtacttgggtgagggtggcttgaaagtcatcaaaatccacaaagcggtggtaagccccggtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaacctataagaaaatgcggcggtggttggcggtagagaggccatcgttctgtagctggagcgccgggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggttgccgaatggcagggaagtgagtcctattttttttttttgccgctcagatgcatcccgtgctgcgacagatgcgtccccaacaacagcccccctcgcagcagcagcaaccacaaaaggctgtccctgcaactactgcaactgccgctgtgagcggtgcgggacagcccgcctatgatctggacttggaagagggcgaaggactggcacgtctaggtgcgccttcgcccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggacagaagacgagtgttgcgggacgaggatttcgaagttgatgaagtgacagggatcagtcctgccagggcacacgtggctgcagccaaccttgtatcggcttacgaacagacagtaaaggaagagcgtaatttccaaaagtcttttaataatcatgtgcgaaccctcattgcccgcgaagaagtcacccttggtttgatgcatttgtgggatttgatggaagctatcattcagaaccctactagcaaacctctgaccgcacagctgtttctggtggtgcaacacagcagagacaatgaggctttcagagaggcgctgctcaacatcaccgaacccgaggggagatggttgtatgatcttatcaacattctacagagtatcatagtgcaggagcggagcctgggcctggccgagaaggtggctgccatcaattactcggttttgagcttgggaaagtattacgctcgcaagatctacaagactccatacgttcccatagacaaggaggtgaagatagatgggttctacatgcgcatgacgctgaaggtgttgaccctgagcgatgatcttggggtgtaccgcaatgacagaatgcatcgcgcggtgagcgccagcaggaggcgcgagttaagcgacagggaactgatgcacagtttgcaaagagctctaactggagctggaaccgagggtgagaattactttgatatgggagctgacttgcagtggcagcctagtcgcagggctctgaacgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgcgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtatatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcattggtgctaccgcggctgagcccgagtctgcaagtccttttcctagtctacccttttctctacacagtgtacgtagcagcgaagtgggtagaataagtcgcccgagtttaatgggcgaagaggagtacctaaacgattccttgctcagaccggcaagagaaaaaaatttcccaaacaatggaatagaaagtttggtggataaaatgagtagatggaagacttatgctcaggatcacagagacgagcctgggatcatggggactacaagtagagcgagccgtagacgccagcgccatgacagacagaggggtcttgtgtgggacgatgaggattcggccgatgatagcagcgtattggacttgggtgggagaggaaggggcaacccgtttgctcatttgcgccctcgcttgggtggtatgttgtaaaaaaaaataaaaaagaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaaaaccatcatgcatactaacatgcccaacgtgaacgagtatatgtttagtaacaagttcaaagcgcgtgtgatggtgtccagaaaacctcctgagggtgttagagtagacgataattatgatcataagcaagatattctaaaatacgagtggttcgagtttactttgccagaaggcaacttttcggtcactatgactatcgacttgatgaacaatgccatcatagacaattacttgaaagtgggcagacagaatggagtgttggaaagtgacattggtgttaagttcgacactaggaacttcaagttgggatgggatccagaaactaagttgatcatgcctggggtttacacctatgaggccttccatcctgacatcgtattgctgcctggctgcggagtggactttaccgaaagccgtctgagcaaccttcttggcattagaaagaaacacccattccaagagggttttaagatcttgtatgaggatttagaaggaggaaatattccagcccttttggatgtagatgcttatgagaacagcaagaaagatcaaaaagccaaaatagaagctgctgcagaagctaaagcaaacatagttgccaacgatccggtaagggtggctaacgctagtgaaatcaggggagacagttttgccgcaacatccgttccgactaaagaatcattattggatgatgtgtctcaaaacatagagttaaaactcactattaagcctgtggaaaaagatggcaaaaacagaagttacaatgtgttggaagataaaatcaacacggcctatcgcagttggtacctttcgtacaattatggcgaccccgaaaaaggagtgcgttcctggacattgctcaccacctcagatgtcacctgcggagcggagcaggtctactggtcgcttccagacatgatgcaggatcctgtcactttccgctccactagacaagtcagtaactaccctgtggtgggtgcagagcttatgcccgtcttttcaaagagcttctacaacgaacaagctgtgtactcccagcagctccgccagtccacctcgcttacgcacgtcttcaaccgctttcctgagaaccagattttaatccgtccgccggcgcccacaattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaaaatgtccgttcttatctcgcccagtaataacaccggttggggtctgcgcgctcccagcaagatgtacggaggcgcacgcaaacgttctacccaacatcccgtgcgtgttcgcgggcattttcgcgctccatggggtgccctcaagggccgcactcgcgttcgaaccaccgtcgatgatgtaatcgatcaggtggttgccgacgcccgtaattatactcctactgcgcctacatctactgtggacgcagttattgacagtgtagtggctgacgctcgcaactatgctcgacgtaagagccggcgaaggcgcattgccagacgtcaccgagctaccactgccatgcgagcagcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggtaaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcagctgaccgattaggcgagtttgcttatggcaagcgtagtagaataaatcccaaggatgaaacagtgtccatacccttggatcatggaaatcccacccctagtcttaaaccggtcactttgcagcaagtgttacccgtaactccgcgaacaggtgttaaacgcgaaggtgaagatttgtatcccactatgcaactgatggtgcccaaacgccagaagttggaggacgttttggagaaagtaaaagtggatccagatattcaacctgaggttaaagtgagacccattaagcaggtagcgcctggtctgggagtacaaactgtagacattaaaattcccactgaaagtatggaagtgcaaactgaacccgcaaagcctactgccacctccactgaagtgcaaacggacccatggatgcccatgcctattacaactgacgccgtcggtcccactcgaagatcccgacgaaagtacggtccagcaagtctgttgatgcccaactatgtcgtacacccatctattattcctactcctggttaccgaggcactcgctactatcgcagccgaaacagtacttcccgccgtcgccgcaagacacctgcaaatcgcagtcgtcgccgtagacgcacaagcaaaccgattcccggcgccctggtgcggcaagtgtaccgcaatggtagtgcggaacctttgacactgccgcgtgcgcgttaccatcctagtatcatcacttaatcaatgttgccgctgcctccttgcagatatggccctcacttgtcgccttcgcgttcccatcactggttaccgaggaagaaactcgcgccgtagaagagggatgttggggcgcggaatgcgacgctacaggcgacggcgtgctatccgcaagcaattgcggggtggttttttgccagccttaattccaattatcgctgctgcgattggcgcaataccaggcatagcttccgtggcggttcaggcctcgcaacgacattgacattggaaaaaaaaaaaacgtataaataaaaaatacaatggactctgacactcctggtactgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggtatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagcccctatggccaccggggtgatgaaaccttctcagttgcatcgacccgtcaccttggatttgccccctcctcctgctgctactgctgtacccgcttctaagcctgtcgctgccccgaaaccagtcgccgtagccaggtcacgtcccgggggcgctcctcgtccaaatgcacactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcatcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcctaccgtagcgccgacccacgatgtgaccaccgatcgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagttttaaaccctattctggtacggcttacaactccctggctcctaaaggcgctccaaatgcatctcagtggttggataagggagttacaagcactggcctagtggacgacggcaatactgatgatggggaagaagccaaaaaagcaacatacacttttggtaatgctccagtaaaagccgaggctgaaatcacaaaagacggattgccggtgggcttggaagtttcaactgaaggtcctaaaccaatctatgctgataagctttatcagccagaacctcaagtgggagacgaaacttggactgacctagacggaaaaaccgaagagtatggagggagggttcttaaacctgaaactaaaatgaaaccctgctacggatcttttgctaaacctactaatattaaaggaggtcaggcaaaggtaaaaccaaaagaagacgatggcactaacaacatcgagtatgacattgacatgaacttctttgacttaagatcacaaagatcagaactcaaacctaaaattgtaatgtatgcagaaaatgtggacctggaatgtccagatactcatgttgtgtacaaacctggagtttcagatgctagttctgagaccaatcttggacaacagtctatgcccaacagacccaactacattggcttcagagataacttcatcggacttatgtactataacagtactggcaacatgggggtactggctggccaagcgtctcagttgaatgcagtggttgacttgcaggacagaaacacagaactgtcttaccaactcttgcttgactctctgggcgacagaaccagatactttagcatgtggaatcaggctgtggacagttatgatcctgatgtacgtgttattgaaaatcatggtgtggaagatgaacttcccaactattgttttccgttggatggtgtcggtccgcgaacagatagttacaaggagattaagccaaatggagaccaatctacttggacaaatgtagacccaactggcagcagtgaacttgctaagggaaatccatttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtaaacatggttctacagagttccctcggtaacgacctacgggtagatggcgccagcatcagttttacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctacttcgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgtcaaggtcaaccctatcccgctaactatccctatccactcattggaacaactgccgtaaatagtgttacgcagaaaaagttcttgtgtgacagaaccatgtggcgcataccgttctcaagcaacttcatgtctatgggagcccttacagacttgggacagaacatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaacagcagctgcaaccatggcctgcggatcccaaaacggctccagcgagcaagagctcagagccattgtccaagacctgggttgcggaccatattttttgggaacctttgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccggtgtattacgctggaaaaatctacccagaccgtgcagggcccccgttctgccgcctgcggacttttctgctgcatgttccttcatgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttctcaatacccattcgccttattttcgctctcatcgtacacacatcgaaagggccactgcgttcgaccgtatggatgtgcaataatgattcatgtaaacaacgtgttcaataaacagcactttattttttacatgtatcgaggctctggattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctcccagcaggtcaggagccgaaatcttgaaatcacaattaggaccagtgctctgagcgcgagagttgcggtacaccggattgcagcactgaaacaccatcagcgacggatgtcttacgcttgccagcacggtgggatctgcaatcatgcccacatccagatcttcagcattggcaatgctgaacggggtcatcttgcaggtctgcctacccatggcgggcacccaattaggcttgtggttacaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcgcagccggcatcattcacacagcagcgggcgtcattgttggctatttgcaccacacttctgccccagcggttttgggtgattttggttcgctcgggattctccttcaaggctcgttgtccgttctcgctggccacatccatctcgataatctgctccttctgaatcataatattgccatgcaagcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgttcacgtactggtgacagatgcgcttgtattgttcgtgctgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttggcgatcttctcaatgcttcttttgccatccttctcaacgatgcgcacgggcgggtagctgaaacccactgctacaagttgcgcctcttctctttcttcttcgctgtcttgactgatgtcttgcatggggacatgtttggtcttccttggcttctttttcgggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagccagacatcgaacaagacccgggctatgtgacaccggtggaacacgaggaagagttgaaacgctttctagagagagaggatgaaaactgcccaaaacagcaagcggataactatcaccaagatgctggaaatagggatcagaacaccgactacctcatagggcttgacggggaagacgcgctccttaaacatctagcaagacagtcactcatagtcaaggatgcattattggacagaactgaagtgcccatcagtgtcgaagagctcagccgcgcctacgagcttaacctattttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcgtcgaggtcacacactttgcataccccgctgtcaacctgccccctaaagtcatgacggccgtcatggaccagttactcattaagcgcgcaagtcccctttcagaagacatgcatgacccagatgcctgtgatgagggtaaaccagtggtcagtgatgagcagctaacccgatggctgggcaccgactctccccgggatttggaagagcgtcgcaagcttatgatggccgtggtgctggttaccgtagaactagagtgtcttcggcgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcacccttaagggggaagcccgccgtgattacatccgcgattgtgtttatctctacctgtgccacacgtggcaaaccggcatgggtgtatggcagcaatgtttagaagaacagaacctgaaagagctaaacaagctcttacagaaatctcttaaggttctgtggacagggttcgacgagcgcaccgtcgcttccgacctggcagacctcatcttcccagagcgtctcagggttactttgcgaaacggactgcctgactttatgagccagagcatgcttaacaattttcgctctttcatcctggaacgctccggtatcctgcccgccacctgctgcgcactgccctccgactttgtgcctctcacctaccgcgaatgccccccgccgctatggagtcactgctacctgttccgtctggccaactacctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgccccggaagattaccacccctatgaaatcaagttctatgaggaccaatcacagcctccgaaagccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaagcaagaagttgaaggtgcagccgccgcccccagaagatatggaggaagattgggacagtcaggcagaggaagcggaggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggccaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcagccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagcgggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcactacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggattactatcgaaggcaaaatacactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcctagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcctagcaaggacaacatcgtaacgttctccattgcttattgcttgtgcgcttgccttcttactgctttactgtgcgtatgcatacacctgcttgtaaccactcgcatcaaaaacgccaataacaaagaaaaaatgccttaacctctttctgtttacagacatggcttctcttacatctctcatatttgtcagcattgtcactgccgctcacggacaaacagtcgtctctatccctctaggacataattacactctcataggacccccaatcacttcagaggtcatctggaccaaactgggaagcgttgattactttgatataatctgcaacaaaacaaaaccaataatagtaacttgcaacatacaaaatcttacattgattaatgttagcaaagtttacagcggttactattatggttatgacagatacagtagtcaatatagaaattacttggttcgtgttacccagttaaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaatttctttttatacagccatggtttccactaccacattccttatgcttactagtcttgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcattatcgctgcagtgacaattggaatatctattcttgtttttaccataacctactacgcctgctgctatagaaaagacaaacataaaggtgatccattacttagatttgatatttaatttgttctttttttttttatttacagtatggtgaacaccaatcatggtacctagaaatttcttcttcaccatactcatttgtgcatttaatgtttgcgctactttcacagcagtagccacagcaaccccagactgtataggagcatttgcttcctatgcactttttgcttttgttacttgcatctgcgtatgtagcatagtctgcctggttattaattttttccaacttctagactggatccttgtgcgaattgcctacctgcgccaccatcccgaataccgcaaccaaaatatcgcggcacttcttagactcatctaaaaccatgcaggctatactaccaatatttttgcttctattgcttccctacgctgtctcaaccccagctgcctatagtactccaccagaacaccttagaaaatgcaaattccaacaaccgtggtcatttcttgcttgctatcgagaaaaatcagaaattcccccaaatttaataatgattgctggaataattaatataatctgttgcaccataatttcatttttgatataccccctatttgattttggctggaatgctcccaatgcacatgatcatccacaagacccagaggaacacattcccctacaaaacatgcaacatccaatagcgctaatagattacgaaagtgaaccacaacccccactactccctgctattagttacttcaacctaaccggcggagatgactgaaacactcaccacctccaattccgccgaggatctgctcgatatggacggccgcgtctcagaacagcgacttgcccaactacgcatccgccagcagcaggaacgcgcggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccagacggagttcttactttaaaatgtttaaccccactaacaaccacaggcggatctctacagctaaaagtgggagggggacttacagtggatgacactgatggtaccttacaagaaaacatacgtgctacagcacccattactaaaaataatcactctgtagaactatccattggaaatggattagaaactcaaaacaataaactatgtgccaaattgggaaatgggttaaaatttaacaacggtgacatttgtataaaggatagtattaacaccttatggactggaataaaccctccacctaactgtcaaattgtggaaaacactaatacaaatgatggcaaacttactttagtattagtaaaaaacggagggcttgttaatggctacgtgtctctagttggtgtatcagacactgtgaaccaaatgttcacacaaaagacagcaaacatccaattaagattatattttgactcttctggaaatctattaactgatgaatcagacttaaaaattccacttaaaaataaatcttctacagcgaccagtgaaactgtagccagcagcaaagcctttatgccaagtactacagcttatcccttcaacaccactactagggatagtgaaaactacattcatggaatatgttactacatgactagttatgatagaagtctatttcccttgaacatttctataatgctaaacagccgtatgatttcttccaatgttgcctatgccatacaatttgaatggaatctaaatgcaagtgaatctccagaaagcaacatagctacgctgaccacatccccctttttcttttcttacattacagaagacgacaactaaaataaagtttaagtgtttttatttaaaatcacaaaattcgagtagttattttgcctccaccttcccatttgacagaatacaccaatctctccccacgcacagctttaaacatttggataccattagagatagacattgttttagattccacattccaaacagtttcagagcgagccaatctggggtcagtgatagataaaaatccatcgcgatagtcttttaaagcgctttcacagtccaactgctgcggatgcgaatccggagtctggatcacggtcatctggaagaagaacgatgggaatcataatccgaaaacggtatcggacgattgtgtctcatcaaacccacaagcagccgctgtctgcgtcgctccgtgcaactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacagccacactcttaagttggtcaaaagaatgctggcttcagttgtaatcaaaactccatcgcatctaattgttctgaggaaatcatccacggtagcatatgcaaatcccaaccaagcaatgcaactggattgcgtttcaagcaggagaggagagggaagagacggaagaaccatgttaatttttattccaaacgatctcgcagtacttcaaattgtagatcgcgcagatggcatctctcgcccccactgtgttggtgaaaaagcacagctaaatcaaaagaaatgcgattttcaaggtgctcaacggtggcttccaacaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacaggtggataaatcagtctttccatcacaagacaagccacagggtctccagctcgaccctcgtaaaacctgtcatggtgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacgcacaagctctaaagtcactctccaacctctccacaatatatatacacaagccctaaactgacgtaatgggagtaaagtgtaaaaaatcccgccaaacccaacacacaccccgaaactgcgtcaccagggaaaagtacagtttcacttccgcaatcccaacaagcgtcacttcctctttctcacggtacgtcacatcccattaacttgcaacgtcattttcccacggccgcgccgccccgtttagccgttaaccccacagccaatcaccacacaccccacaatttttaaaatcacctcatttacatattggcaccattccatctataaggtatattattgatgatggccaagctatttaggtgacactatagaatactcaagctatgcatcaagcttggtaccgagctcggatccactagtaacggccgccagtgtgctggaattcgcccttgtttaaacgcgatcg

SEQ ID NO: 13 - DNA, 35016 bp, Adenovirus B35
  MISC_FEATURE (1)..(35016): Complete Genome
cgatcgcgtttaaacaagggcgaattccagcacactggcggccgctcgagcatgcatctagagggcccaattcgccctatagtgagtcgtattacaatgcactggcccatcatcaataatataccttatagatggaatggtgccaatatgtaaatgaggtgattttaaaaagtgtgggccgtgtggtgattggctgtggggttaacggttaaaaggggcggcgcggccgtgggaaaatgacgttttatgggggtggagtttttttgcaagttgtcgcgggaaatgttacgcataaaaaggcttcttttctcacggaactacttagttttcccacggtatttaacaggaaatgaggtagttttgaccggatgcaagtgaaaattgctgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcaatactccaggggtgattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgatattcaagcacctgttcctgtggacgtgcgcaagcccattcctgtgaagcttaagcctgggaaacgtccagcagtggagaaacttgaggacttgttacagggtggggacggacctttggacttgagtacacggaaacgtccaagacaataagtgttccatatccgtgtttacttaaggtgacgtcaatatttgtgtgagagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagagcgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatccagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagccagaggatgattgggaggtggccattaaaaattatgccaagatagctttgaggcctgataaacagtataagatcagtagacggattaatatccggaatgcttgttacatatctggaaatggggctgaggtggtaatagatactcaagacaagacagttattagatgctgcatgatggatatgtggcctggagtagtcggtatggaagcagtcacttttgtaaatgttaagtttaggggagatggttataatggaatagtgtttatggccaataccaaacttatattgcatggttgtagcttttttggtttcaacaatacctgtgtagatgcctggggacaggttagtgtacgggggtgtagtttctatgcgtgttggattgccacagctggcagaaccaagagtcaattgtctctgaagaaatgcatattccaaagatgtaacctgggcattctgaatgaaggcgaagcaagggtccgtcactgcgcttctacagatactggatgttttattttaattaagggaaatgccagcgtaaagcataacatgatttgtggtgcttccgatgagaggccttatcaaatgctcacttgtgctggtgggcattgtaatatgctggctactgtgcatattgtttcccatcaacgcaaaaaatggcctgtttttgatcacaatgtgttgaccaagtgcaccatgcatgcaggtgggcgtagaggaatgtttatgccttaccagtgtaacatgaatcatgtgaaagtgttgttggaaccagatgccttttccagaatgagcctaacaggaatctttgacatgaacacgcaaatctggaagatcctgaggtatgatgatacgagatcgagggtgcgcgcatgcgaatgcggaggcaagcatgccaggttccagccggtgtgtgtagatgtgaccgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgacatgagtggaaatgcttcttttaaggggggagtcttcagcccttatctgacagggcgtctcccatcctgggcaggagttcgtcagaatgttatgggatctactgtggatggaagacccgttcaacccgccaattcttcaacgctgacctatgctactttaagttcttcacctttggacgcagctgcagccgctgccgccgcctctgtcgccgctaacactgtgcttggaatgggttactatggaagcatcgtggctaattccacttcctctaataacccttctacactgactcaggacaagttacttgtccttttggcccagctggaggctttgacccaacgtctgggtgaactttctcagcaggtggccgagttgcgagtacaaactgagtctgctgtcggcacggcaaagtctaaataaaaaaaattccagaatcaatgaataaataaacgagcttgttgttgatttaaaatcaagtgtttttatttcatttttcgcgcacggtatgccctggaccaccgatctcgatcattgagaactcggtggattttttccagaatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggaggggtgcattcgaggtgaaattatgtgcattttggattggatttttaagttggcaatattgccgccaagatcccgtcttgggttcatgttatgaaggactaccaagacggtgtatccggtacatttaggaaatttatcgtgcagcttggatggaaaagcgtggaaaaatttggagacacccttgtgtcctccgagattttccatgcactcatccatgataatagcaatggggccgtgggcagcggcgcgggcaaacacgttccgtgggtctgacacatcatagttatgttcctgagttaaatcatcataagccattttaatgaatttggggcggagcgtaccagattggggtatgaatgttccttcgggccccggagcatagttcccctcacagatttgcatttcccaagctttcagttctgagggtggaatcatgtccacctggggggctatgaagaacaccgtttcgggggcgggggtgattagttgggatgatagcaagtttctgagcaattgagatttgccacatccggtggggccataaataattccgattacaggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggttttagaccgtcagccatgggcattttggaaagagtttgctgcaaaagttctagtctgttccacagttcagtgatgtgttctatggcatctcgatccagcagacctcctcgtttcgcgggtttggacggctcctggagtagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcattctgctggtggagaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacagcttgggcgcaaggaaaatggattctggggagtatgcatccgcgccgcaggaggcgcaaacagtttcacattccaccagccaggttaaatccggttcattggggtcaaaaacaagttttccgccatattttttgatgcgtttcttacctttggtctccataagttcgtgtcctcgttgagtgacaaacaggctgtccgtatctccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccagggcatgggatgggtgagagcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgagaaattggtatttgaagtccatgtcgtcacaggctccctgttcccagagttggaagtctacccgtttcttgtaggcggggttgggcaaagcgaaagtaacatcattgaagagaatcttaccggctctgggcataaaattgcgagtgatgcggaaaggctgtggtacttccgctcgattgttgatcacctgggcagctaggacgatttcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggatttgcatgtaggaatgatgaccaaagatctaccgccagtgctgtttgtaactggtcccgatactgacgaaaatgccggccaattgccattttttctggagtgacacagtagaaggttctggggtcttgttgccatcgatcccacttgagtttaatggctagatcgtgggccatgttgacgagacgctcttctcctgagagtttcatgaccagcatgaaaggaactagttgtttgccaaaggatcccatccaggtgtaagtttccacatcgtaggtcaggaagagtctttctgtgcgaggatgagagccgatcgggaagaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagctgtacctggcttcccttgacgagaaatttcagtgggaagccgaggcctggcgattgtatctcgtgctcttctatattcgctgtatcggcctgttcatcttctgtttcgatggtggtcatgctgacgagcccccgcgggaggcaagtccagacctcggcgcgggaggggcggagctgaaggacgagagcgcgcaggctggagctgtccagagtcctgagacgctgcggactcaggttagtaggtagggacagaagattaacttgcatgatcttttccagggcgtgcgggaggttcagatggtacttgatttccacaggttcgtttgtagagacgtcaatggcttgcagggttccgtgtcctttgggcgccactaccgtacctttgttttttcttttgatcggtggtggctctcttgcttcttgcatgctcagaagcggtgacggggacgcgcgccgggcggcagcggttgttccggacccgggggcatggctggtagtggcacgtcggcgccgcgcacgggcaggttctggtattgcgctctgagaagacttgcgtgcgccaccacgcgtcgattgacgtcttgtatctgacgtctctgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctttcgacggtggccgcgaggtcattggagatacggcccatgagttgggagaatgcattcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcaatgtgttcggcgacgaagaaatacatgatccatcgtctcagcggcatttcgctaacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccgggatctcttcttcctcttctatctcttcttccactaacatctcttcttcgtcttcaggcgggggcggagggggcacgcggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcgcgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagcccctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttttgccgctcagatgcatcccgtgctgcgacagatgcgcccccaacaacagcccccctcgcagcagcagcagcagcaaccacaaaaggctgtccctgcaactactgcaactgccgccgtgagcggtgcgggacagcccgcctatgatctggacttggaagagggcgaaggactggcacgtctaggtgcgccttcgcccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgagacgaggatttcgaagttgatgaagtgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtagctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgatctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctgttattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggtgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtacctaaacgattccttgctcagaccggcaagagaaaaaaatttcccaaacaatggaatagaaagtttggtggataaaatgagtagatggaagacttatgctcaggatcacagagacgagcctgggatcatggggactacaagtagagcgagccgtagacgccagcgccatgacagacagaggggtcttgtgtgggacgatgaggattcggccgatgatagcagcgtgttggacttgggtgggagaggaaggggcaacccgtttgctcatttgcgccctcgcttgggtggtatgttgtgaaaaaaaataaaaaagaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcagaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttggaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtttactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaatgtccattcttatctcgcccagtaataacaccggttggggtctgcgcgctccaagcaagatgtacggaggcgcacgcaaacgttctacccaacatcccgtgcgtgttcgcggacattttcgcgctccatggggtgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcaatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaaacgtataaataaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagtttcaaaccctattctggtacggcttacaactctctggctcctaaaggcgctccaaatgcatctcaatggattgcaaaaggcgtaccaactgcagcagccgcaggcaatggtgaagaagaacatgaaacagaggagaaaactgctacttacacttttgccaatgctcctgtaaaagccgaggctcaaattacaaaagagggcttaccaataggtttggagatttcagctgaaaacgaatctaaacccatctatgcagataaactttatcagccagaacctcaagtgggagatgaaacttggactgacctagacggaaaaaccgaagagtatggaggcagggctctaaagcctactactaacatgaaaccctgttacgggtcctatgcgaagcctactaatttaaaaggtggtcaggcaaaaccgaaaaactcggaaccgtcgagtgaaaaaattgaatatgatattgacatggaattttttgataactcatcgcaaagaacaaacttcagtcctaaaattgtcatgtatgcagaaaatgtaggtttggaaacgccagacactcatgtagtgtacaaacctggaacagaagacacaagttccgaagctaatttgggacaacagtctatgcccaacagacccaactacattggcttcagagataactttattggactcatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactattgttttccactggacggcataggtgttccaacaaccagttacaaatcaatagttccaaatggagaagataataataattggaaagaacctgaagtaaatggaacaagtgagatcggacagggtaatttgtttgccatggaaattaaccttcaagccaatctatggcgaagtttcctttattccaatgtggctctgtatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatctatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggcccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctctcatcgtacacacatcgaaagggccactgcgttcgaccgtatggatgttcaataatgactcatgtaaacaacgtgttcaataaacatcactttatttttttacatgtatcaaggctctggattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctctgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttggctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcttcgtttacgtactggtgacagatgcgcttgtattgttcgtgttgctcaggcattagtttaaaacaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttttcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacagcgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagctgcgcctacgagcttaaccttttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcgtcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctccccgggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcacccttaagggggaagcccgccgtgattacatccgcgattgtgtctatctctacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgccactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcttgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccgacagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcagcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtagaggagtttactccctctgtctacttcaaccccttctccggatctcctgggcactacccggacgagttcataccgaacttcgacgcgattagcgagtcagtggacggctacgattgatgtctggtgacgcggctgagctatctcggctgcgacatctagaccactgccgccgctttcgctgctttgcccgggaacttattgagttcatctacttcgaactccccaaggatcaccctcaaggtccggcccacggagtgcggattactatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacaaaacttttcctgtcgtccaggactctgttaacttcacctttcctactcacaaactagaagctcaacgactacaccgcttttccagaagcattttccctactaatactactttcaaaaccggaggtgagctccacggtctccctacagaaaacccttgggtggaagcgggccttgtagtactaggaattcttgcgggtgggcttgtgattattctttgctacctatacacaccttgcttcactttcctagtggtgttgtggtattggtttaaaaaatggggcccatactagtcttgcttgttttactttcgcttttggaaccgggttctgccaattacgatccatgtctagactttgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcctagcaaggacaacatcgtaacgttctccattgcttattgcttgtgcgcttgccttcttactgctttactgtgcgtatgcatacacctgcttgtaaccactcgcatcaaaaacgccaataacaaagaaaaaatgccttaacctctttctgtttacagacatggcttctcttacatctctcatatttgtcagcattgtcactgccgctcacggacaaacagtcgtctctatcccactaggacataattacactctcataggacccccaatcacttcagaggtcatctggaccaaactgggaagcgttgattactttgatataatctgtaacaaaacaaaaccaataatagtaacttgcaacatacaaaatcttacattgattaatgttagcaaagtttacagcggttactattatggttatgacagatacagtagtcaatatagaaattacttggttcgtgttacccagttgaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaatttctttttatacagccatggtttccactaccacattccttatgcttactagtctcgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcatcatcgctgcagtgacaattggaatatctattcttgtttttaccataacctactacgcctgctgctatagaaaagacaaacataaaggtgatccattacttagatttgatatttaatttgttctttttttttatttacagtatggtgaacaccaatcatggtacctagaaatttcttcttcaccatactcatctgtgcttttaatgtttgcgctactttcacagcagtagccacagcaaccccagactgtataggagcatttgcttcctatgcactttttgcttttgttacttgcatctgcgtatgtagcatagtctgcctggttattaattttttccaacttctagactggatccttgtgcgaattgcctacctgcgccaccatcccgaataccgcaaccaaaatatcgcggcacttcttagactcatctaaaaccatgcaggctatactaccaatatttttgcttctattgcttccctacgctgtctcaaccccagctgcctatagtactccaccagaacaccttagaaaatgcaaattccaacaaccgtggtcatttcttgcttgctatcgagaaaaatcagaaatccccccaaatttaataatgattgctggaataattaatataatctgttgcaccataatttcatttttgatataccccctatttgattttggctggaatgctcccaatgcacatgatcatccacaagacccagaggaacacattcccccacaaaacatgcaacatccaatagcgctaatagattacgaaagtgaaccacaacccccactactccctgctattagttacttcaacctaaccggcggagatgactgaaacactcaccacctccaattccgccgaggatctgctcgatatggacggccgcgtctcagaacaacgacttgcccaactacgcatccgccagcagcaggaacgcgtggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccaacaaagtggagatactaagggttgcattcactgctcctgcgattccatcgagtgcacctacaccctgctgaagaccctatgcggcctaagagacctgctaccaatgaattaaaaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccagacggagttcttactttaaaatgtttaaccccactaacaaccacaggcggatctctacagctaaaagtgggagggggacttacagtggatgacactgatggtaccttacaagaaaacatacgtgctacagcacccattactaaaaataatcactctgtagaactatccattggaaatggattagaaactcaaaacaataaactatgtgccaaattgggaaatgggttaaaatttaacaacggtgacatttgtataaaggatagtattaacaccttatggactggaataaaccctccacctaactgtcaaattgtggaaaacactaatacaaatgatggcaaacttactttagtattagtaaaaaatggagggcttgttaatggctacgtgtctctagttggtgtatcagacactgtgaaccaaatgttcacacaaaagacagcaaacatccaattaagattatattttgactcttctggaaatctattaactgaggaatcagacttaaaaattccacttaaaaataaatcttctacagcgaccagtgaaactgtagccagcagcaaagcctttatgccaagtactacagcttatcccttcaacaccactactagggatagtgaaaactacattcatggaatatgttactacatgactagttatgatagaagtctatttcccttgaacatttctataatgctaaacagccgtatgatttcttccaatgttgcctatgccatacaatttgaatggaatctaaatgcaagtgaatctccagaaagcaacatagctacgctgaccacatccccctttttcttttcttacattacagaagacgacaactaaaataaagtttaagtgtttttatttaaaatcacaaaattcgagtagttattttgcctccaccttcccatttgacagaatacaccaatctctccccacgcacagctttaaacatttggataccattagagatagacattgttttagattccacattccaaacagtttcagagcgagccaatctggggtcagtgatagataaaaatccatcgcgatagtcttttaaagcgctttcacagtccaactgctgcggatgcgactccggagtttggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtttcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacagccacactcttaagttggtcaaaagaatgctggcttcagttgtaatcaaaactccatcgcatctaattgttctgaggaaatcatccacggtagcatatgcaaatcccaaccaagcaatgcaactggattgcgtttcaagcaggagaggagagggaagagacggaagaaccatgttaatttttattccaaacgatctcgcagtacttcaaattgtagatcgcgcagatggcatctctcgcccccactgtgttggtgaaaaagcacagctaaatcaaaagaaatgcgattttcaaggtgctcaacggtggcttccaacaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccaccagtaatatcatcgaagttgctggaaatataatcaggcagagtttcttgtagaaattgaataaaagaaaaatttgccaaaaaaacattcaaaacctctgggatgcaaatgcaataggttaccgcgctgcgctccaacattgttagttttgaattagtctgcaaaaataaaaaaaaaacaagcgtcatatcatagtagcctgacgaacaggtggataaatcagtctttccatcacaagacaagccacagggtctccagctcgaccctcgtaaaacctgtcatcgtgattaaacaacagcaccgaaagttcctcgcggtgaccagcatgaataagtcttgatgaagcatacaatccagacatgttagcatcagttaaggagaaaaaacagccaacatagcctttgggtataattatgcttaatcgtaagtatagcaaagccacccctcgcggatacaaagtaaaaggcacaggagaataaaaaatataattatttctctgctgctgtttaggcaacgtcgcccccggtccctctaaatacacatacaaagcctcatcagccatggcttaccagagaaagtacagcgggcacacaaaccacaagctctaaagtcactctccaacctctccacaatatatatacacaagccctaaactgacgtaatgggactaaagtgtaaaaaatcccgccaaacccaacacacaccccgaaactgcgtcaccagggaaaagtacagtttcacttccgcaatcccaacaagcgtcacttcctctttctcacggtacgtcacatcccattaacttacaacgtcattttcccacggccgcgccgccccttttaaccgttaaccccacagccaatcaccacacggcccacactttttaaaatcacctcatttacatattggcaccattccatctataaggtatattattgatgatgggccagtgaattgtaatacgactcactatagggcgaattgggccctctagatgcatgctcgagcggccgccagtgtgatggatatctgcagaattcgcccttccttaattaacctgcag

SEQ ID NO: 14 - DNA, 36015 bp, Adenovirus C1
  MISC_FEATURE (1)..(36015): Complete Genome
ttaattaacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggtaaaagtgacgtttttggtgtgcgccggtgtacacgggaagtgacaattttcgcgcggttttaggcggatgttgtagtaaatttgggcgtaaccgagtaagatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatttgccacggaggtgttattaccgaagaaatggccgccagtcttttggaccagctaatcgaagaggtactggctgataatcttccacctcctagccattttgaaccacctacccttcacgaactgtatgatttagacgtgacggcccccgaagatcccaacgaggaggcggtttcgcagatttttcctgactctgtaatgttggcggcgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcagcccgggcacggttgcaggtcttgtcattatcatcggaggaatacgggggacccagatattatgtgttcgctttgctatatgaggacctgtggcatgtttgtctacagtaagtgaaattatgggcagtgggtgatagagtggtgggttcggtgtggtaattttttttttaattttttgcagttttgtggtttaaagaattttgtattgtgattttttttaaaaggtcctgtgtctgaacctgagcctgagcccgagccagaaccggaacctgcaagacctgcccggcgtcctaaaatggtgcctgctatcctgagacgcccgacatcacctgtgtccagagaatgcaatagtagtacggatagctgtgactccggtccttctaacacacctcctgagatacatccggtggtcccgctgtgccccattaaaccagttgccgtgagagttggtgggcgtcgccgggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaaaagggtgagataatgtttaacttgcatggcgtgttaaatggggcggggcttaaagggtatataatgcgccgtgggctaatcttggttacatttgacctcatggaggcttgggagtgtttggaagatttttctgctgtgcgtaacttgctggaacagagctctaacagtacctcctggttttggaggtttctgtggggctcctcccaagcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatttgtggagagcggtggtgagacacaagaatcgcctactactgttgtcttccgtccgcccggcaataataccgacggaggagcagcagcagcaacagcagcagcaggaggaagccaggcggcggcggcggcaggagcagagcccatggaacccgagagccggcctggaccctcgggaatgaatgttgtacaggtggctgaactgtttccagaactgagacgcattttaacaattaacgaggatgggcaggggctaaagggggtaaagagggagcggggggcttttgaggctacagaggaggttaggaatttaacttttagcttaatgaccagacaccgtcctgagtgtgttacttttcagcagattaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagattagcaaacttgtaaatattaggaattgttgctacatttctgggaacggggccgaggtggagatagatacggaggatagggtggcctttagatgtagcatgataaatatgtggccgggggtacttggcatggacggggtggttattatgaatgtgaggtttactggccccaattttagcggtacggttttcctggccaataccaaccttatcctacacggtgtaagcttctatgggtttaacaatacctgcgtggaagcctggaccgatgtaagggttcgaggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtgtgtggcaactgcgaggacagggcctctcagatgctaacctgctcggacggcaactgtcacctgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgaaagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggagctgcgccagcaggtttctgccctgaaggcttcctcccctcccaatgcggtttaaaacataaataaaaaccagactctgtttggatttggatcaagcaagtgtattgctgtctttatttaggggttttgcgcgcgcggtaggcccgggaccagcggtctcggtcgttgagggtcctgtgtattttttccaggacgtggtagagatggctctggatgttcagatacatgggcataagcccgtctctggggtggaggtagcaccactgcagagcttcatgctgcggggtggtgttgtagatgatccagtcgtagcaggagcgctgggcgtggtgcctaaaaatgtcctttagaagcaagctgattgccaggggcaggcccttggtgtaagtgtttacaaagcggttaagctgggatgggtgcatacgtggggatatgagatgcatcttggactgtatttttaggttggctatgttcccagccatatccctcctgggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcaataaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaagggggccacttcgttaagcatgtccctgacacgcatgttttccctgaccaaatccgctagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcatggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtccccctcttcggcatcaaggaaggtgattggtttataggtgtatgccacgtgaccgggtgttcctgaagggggggtataaaagggggtgggggcgcgttcgtcctcactctcttccgcatcgctgtctgcgagggccagctgttggggtgagtactccctctggaaagcgggcatgacttctgcgctaaggttgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtccgcgtccacggtaaagatcccgggcaacaggcgcgcgtcgaagtagtctatcttgcatccttgcaagtctaacgcctgctgccatgcgcgggcggcaagcgcgcgctcgtatgggttgagtgggggaccccatggcatggggtgggtgagcgcggaggcgtacatgccgcagatgtcgtaaacgtagaggggctccctgagtattccaagatatgtagggtagcatcttccaccgcggatgctggcgcgcacgtaatcgtatagttcgtgcgagggggcgaggagttcgggaccgaggttgctacgggcgggctgctctgctcggaagacgatctgcctgaagatggcatgcgagttcgatgatatggttggacgctggaagacgttgaagctggcgtctgtaagacctaccgcatcacgcacgaaggaggcgtaggagtcgcgcagcttgttgaccagctcggcggtgacctgcacgtctagggcacagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcgggtttggtagggcgaaggtgacatcgttgaagagtatctttcccgcgcgaggcataaaattgcgtgtgatgcggaagggtcccggcacctcggaacggttgttaattacctgggcggcgagcacgatctcgtcaaagccgttgatgttgtggcccacgatgtaaagttccaagaagcgcggggtgcccttaatggagggcaattttttaagttcttcgtaggtaagctcttcaggggagttgagcccgtgctctgacagggcccagtctgcaagatgagggttggaagcaacgaatgagctccacaggtcacgggccattagcatttgcagatggtcgcgaaaggtcctaaactggcgacctacggccattttttctggggtgatgcagtagaaggtaagcgggtcttgttcccagcggtcccatccaaggtccacggctaggtctcgcgcggcggtcactagaggctcatctccgccgaatttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcaaatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcacggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcattggctgaagcagggccaggtcggcgacaacgcgctcggctaatatggcctgctgcacctgcgtgagggtagactggaagtcatccatgtcaacaaagcggtggtatgcgcccgtgttgatggtgtaagtgcagttggccataacggaccagttaacggtctggtggcccggctgcgagagctcggtgtatctgagacgcgagtaagcccttgagtcaaagacgtagtcgttgcaagtccgcacgaggtactggtatcctaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagcgctccttttggcttccttccaggcgcggcggctgctgcgctagctttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctccccttctcctaccgcgtcaggaggggcaacatccgcggctgacgcggcggcagatggtgattacgaacccccgcggcgccgggcccggcactacctggacttggaggagggcgagggcctggcgcggctaggagcgccctctcctgagcgacacccaagggtgcagctgaagcgtgacacgcgcgaggcgtacgtgccgcggcagaacctgtttcgtgaccgcgagggagaggagcccgaggagatgcgggatcgaaagttccatgcagggcgcgagttgcggcatggcctgaaccgcgagcggttgctgcgcgaggaggactttgagcccgacgcgcggaccgggattagtcccgcgcgcgcacacgtggcggccgccgacctggtaaccgcgtacgagcagacggtgaaccaggagattaactttcaaaaaagctttaacaaccacgtgcgcacgcttgtagcgcgcgaggaggtggctataggactgatgcatctgtgggactttgtaagcgcgctggagcaaaacccaaatagcaagccgctcatggcgcagttgtttcttatagtgcagcacagcagggacaacgaggcattcagggatgcgctgttaaacatagtagagcccgagggccgctggctgctcgatttgataaatattctgcagagcatagtggtgcaggagcgcagcttgagcctggctgacaaggtggccgccattaactattccatgctcagtctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatatttctgatcagatgatgcaagacgcaacggacccggcggtgcgggcggcgctgcagagccagccgtccggccttaactccacggacgactggcgccaggtcatggaccgcatcatgtcgctgactgcgcgcaaccctgacgcgttccggcagcagccacaggccaaccggctctccgcaattctggaagcggtggtcccggcgcgcgcaaaccccacgcacgagaaggtgctggcgatcgtaaacgcgctggccgaaaacagggccatccggcccgatgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtccgggccagactattttttccagaccagtagacaaggcctgcagaccgtaaacctgagccaggctttcaagaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgagaggccataggtcaggcgcatgtggacgagcatactttccaggagattacaagtgttagccgcgcgctggggcaggaggacacgggcagcctggaggcaaccctgaactacctgctgaccaaccggcggcagaagatcccctcgttgcacagtttaaacagcgaggaggagcgcattttgcgctatgtgcagcagagcgtgagccttaacctgatgcgcgacggggtaacgcccagcgtggcgctggacatgaccgcgcgcaacatggaaccgggcatgtatgcctcaaaccggccgtttatcaatcgcctaatggactacttgcatcgcgcggccgccgtgaaccccgagtatttcaccaatgccatcttgaacccgcactggctaccgccccctggtttctacaccgggggatttgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctaggcgaggaggagtacctaaacaactcgttgctgcagccgcagcgcgaaaagaacctgcctccggcgtttcccaacaacgggatagagagcctagtggacaagatgagtagatggaagacgtatgcgcaggagcacagggatgtgcccggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagcgtggtgagcgcggcgccagtggcggcggcgctgggttcccccttcgatgctcccctggacccgccgttcgtgcctccgcggtacctgcggcctaccggggggagaaacagcatccgttactctgagttggcacccctattcgacaccacccgtgtgtaccttgtggacaacaagtcaacggatgtggcatccctgaactaccagaacgaccacagcaactttctaaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgctcgcttactaaggacaaacaggtggagctgaaatatgagtgggtggagttcacgctgcccgagggcaactactccgagacaatgaccatagaccttatgaacaacgcgatcgtggagcactacttgaaagtgggcaggcagaacggggttctggaaagcgacatcggggtaaagtttgacacccgcaacttcagactggggtttgacccagtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgacctggagggtggtaacattcccgcactgttggatgtggacgcctaccaggcaagcttgaaagatgacaccgaacagggcgggggtggcgcaggcggcggcaacaacagtggcagcggcgcggaagagaactccaacgcggcagccgcggcaatgcagccggtggaggacatgaacgatcatgccattcgcggcgacacctttgccacacgggcggaggagaagcgcgctgaggccgaggcagcggccgaagctgccgcccccgctgcggaggctgcacaacccgaggtcgagaagcctcagaagaaaccggtgattaaacccctgacagaggacagcaagaaacgcagttacaacctaataagtaatgacagcaccttcacccagtaccgcagctggtaccttgcatacaactacggcgaccctcaggccgggatccgctcatggaccctgctttgcactcctgacgtaacctgcggctcggagcaggtatactggtcgttgcccgacatgatgcaagaccccgtgaccttccgctccacgagccagatcagcaactttccggtggtgggcgccgagctgttgcccgtgcactccaagagcttctacaacgaccaggccgtctactcccagctcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgtttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgctatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgttgcacgcgaccgcgcccaggcggcgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcgcccaccgtgcagctcatggtgcccaagcgccaacgactggaagatgtcttggaaaaaatgaccgtggagcctgggctggagcccgaggtccgcgtgcgaccaatcaagcaggtggcaccgggactgggcgtgcagaccgtggacgttcagatacccaccaccagtagcactagtattgccactgccacagagggcatggagacacaaacgtccccggtcgcctcggcggtggcagatgccgcggtgcaggcggccgctgcggccgcgtccaaaacctctacggaggtgcaaacggacccgtggatgtttcgcgtttcagccccccggcgtccgcgccgttcgaggaagtacggcgccgccagcgcgctactgcccgaatatgccctacatccttccatcgcgcctacccccggctatcgtggctacacctaccgccccagaagacgagcaactacccgacgccgaatcaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccaaatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgttgccagatgggcgtggcgaaaagcgcccgcgccccgacagggaagagactctggtgacacaaatcgacgagcctccctcgtacgaggaggcgctaaagcaaggcctgcccaccacccgtcccatcgcgcccatggctaccggagtgttgggccagcacacacctgtaacgctggacctgcctccccccgctgacacccagcagaaacctgtgctgccagggccgtccgccgttgttgtaacccgccctagccgcgcgtccctgcgccgtgccgccagcggtccgcgatcgttgcggcccgtagccagtggcaactggcaaagcacactgaacagcatcgtgggtctgggggtgcaatccctaaagcgccgacgatgcttttgaatagctaacgtgtcgtatgtgtgtcatgtatgcgtccatgtcgccgccagaggagctgctgagtcgccgcgcgcccgctttccaagatggctaccccttcgatgatgccgcagtggtcttacatgcacatctcgggccaggacgcctcggagtacctgagccccgggctggtgcagttcgcccgcgccaccgagacgtacttcagcctgaataacaagtttagaaaccccacggtggcgcctacgcacgacgtgaccacagaccggtctcagcgtttgacgctgcggtttatccccgtggaccgcgaggataccgcatactcgtacaaggcgcggtttaccctggctgtgggtgacaaccgtgtgcttgacatggcttccacatactttgacattcgcggcgtgctggaccggggccccacttttaagccctactccggcactgcctacaacgctctagcccccaaaggcgctcccaattcctgcgagtgggaacaagaagaaccaactcaggaaatggctgaagaacttgaagatgaggaggaggcagaggaggaggaggcagaggaggaggcagaagcaccacaagctgatcagaaggttaagaagactcatgtatatgctcaggctcctttggcaggggaaaaaattaccgccaatggcttacaaatagtttctgatacccaaactgaaggcaatccagtttttgccgatcccacttatcaacctgaacctcaggttggagaatctcagtggaatgaagctgaagcaactgcatctggaggcagagtactaaaaaagactactcccatgaaaccatgctacggatcgtatgccagacctacaaataaaaatgggggtcaaggtatactagtagcaaacaaccaaggtgctctagagtctaaagttgaaatgcagttttttgccccctctggcactgccatgaatgaaagaaatgctgttcagccaagtattgttttgtacagtgaggatgttaatatggaaactcctgatactcacatttcatacaaaccaagcaaaactgatgaaaactctaaggctatgttgggtcaacaagcaatgccaaacagacccaattacatcgcttttagggacaattttattggccttatgtattacaacagcactggtaacatgggtgtccttgctggacaagcatcacagctaaatgccgtggtagacttgcaggacagaaacacagagctgtcatatcaacttttgcttgattctattggcgatagaaccagatacttttccatgtggaatcaggctgtagacagctatgatccagatgtcagaatcattgaaaatcatggaactgaggatgagttgccaaattactgcttcccacttggcggtataggggtaactgacacctaccaaggtataaaatcaaacggaaacggtaatcctcaaaactggaccaaaaatgacgattttgcggcacgtaatgaaataggtgtgggaaacaactttgccctggagattaaccttaatgccaacctatggagaaatttcctctactccaacattgcactgtacctgcctgacaagctaaaatacactcctacaaatgtggaaatatctcccaaccctaattcatacgattatatgaacaagcgagtggtggctcccgggttggtggattgctacattaaccttggagcgcgttggtcattggactacatggacaacgtcaacccctttaaccatcaccgcaatgcgggcctacgctaccgctccatgttgctgggcaacggtcgctacgtgccctttcacatccaggttcctcagaagttttttgccattaagaacctcctactcttgccgggctcatacacctacgagtggaacttcaggaaagatgttaacatggtcctgcaaagctccctaggaaacgacctaagagttgacggagccagcattaagtttgacagcatttgcctctacgccaccttttttccgatggcccacaacaccgcctcaacgcttgaagccatgcttagaaacgacaccaacgaccagtcctttaacgactacctatccgccgccaacatgctttaccccatacccgccaacgccaccaacgtgcccatctctatcccctcgcgcaactgggcggctttccgaggctgggcctttacgcgccttaagactaaggaaaccccatccctgggttccggctacgacccttactatacctactctggctccataccctacctagacggaaccttttaccttaatcacaccttcaaaaaggtagccatcacctttgactcttctgttagctggcctggcaatgaccgtctgcttacccccaacgagtttgagatcaagcgttcagttgacggagagggctacaacgttgcccaatgcaacatgaccaaagactggttcttggtacagatgctagccaactacaacataggctaccagggcttttatatcccagaaagctataaggaccgcatgtactccttctttagaaacttccagcccatgagccgtcaggtggtggacgataccaaatacaaggactaccaacaggtgggcatcctccaccagcacaataactctggctttgttggttacctcgctcccaccatgcgagagggacaggcctaccccgccaacttcccctacccgcttataggcaagaccgcggttgacagtattacccagaaaaagtttctttgcgaccgcaccctttggcgcattccattctccagtaactttatgtccatgggtgcactcacagacctgggccaaaaccttctctatgcaaactccgcccacgcgctagatatgacttttgaggtggatcccatggacgagcccacccttctttatgttttgtttgaagtctttgacgtggtccgtgtgcaccagccgcaccgcggcgtcatcgagaccgtgtacctgcgcacgcccttctcggctggcaacgccacaacataaagaagcaagcaacatcaacaacagctgccgccatgggctccagtgagcaggaactaaaagccattgtcaaagatcttggttgtggaccatattttttgggcacctatgacaagcgcttcccaggctttgtttccccacacaagctcgcctgcgccatagttaacacggccggtcgcgagactgggggtgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattacaggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactcttgggtgattatttaccccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggccccgatatcttgaagtcgcagttggggcctccgccctgcgcgcgcgagttgcgatacacagggttgcagcactggaacactatcagcgccgggtgatgcacgctggccagcacgctcttgtcggagatcagatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccggtctgggcgttaggatacagcgccttcataaaggcctggatctgcttaaaagccacctgggcctttgcgccttcggaaaaaaacatgccgcaagacttgccggaaaactgattcgccggacaggccgcgtcgtgcacgcagcacctcgcgtcggtgttggagatctgtaccacgcttcggccccaacggttcttcacaatcttggccttgctagactgctccttcagcgcgcgctgcccgttttcgctcgtcacatccatttcaatcacgtgctccttgtttatcataatgctcccgtgtagacacttaagctcgccttcgatctcagcgcagcggtgcagccacaacgcgcagcccgtgggctcgtggtgcttgtaggtcacctctgcaaacgactgcaggtacgcttgcaggaatcgccccatcatcgtcacaaaggtcttgttgctggtaaaggtcagctgcaacccgcggtgctcctcgttcagccaggtcttacatacggccgccagggcttccacttggtcaggcagtagcttgaagttcgcctttagatcgttatccacgtgatacttgtccatcagcgcgcgcgcagcctccatgcccttctcccacgcagacacgatcggcagactcagcgggttcattaccgtgctttcactttccgcttcgctgggctcttcctcttcctcttgcatccgcataccccgcgccactgggtcgtcttcattcagccgccgcaccgtgcgcttacctcccttgccgtgcttaattagcaccggtgggttgctgaaacccaccatttgtagcgccacatcttctctttcttcctcgctgtccacaatcacctctggggatggcgggcgctcgggcttgggagatgggcgcttctttttcttcttgggcgcgttggccaaatccgccgccgaggttgatggccgcgggctgggtgtgcgcggcaccagcgcgtcttgtgacgagtcttcttcgtcctcggactcgagacgccgcctcagccgcttttttgggggcgcgcggggaggcggcggcgacggcgacggggacgacacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctctgagttcgccaccaccgcctccaccgatgccgccaacgcgcctaccaccttccccgtcgaggcacccccgcttgaggaggaggaagtgactatcgagcaggacccaggttttgtaagcgaagacgacgaggaccgctcagtaccaacagaggataaaaagcaagaccaggacgacgcagaggcaaacaaggagcaagtcgggcggggggacgagaggcatggcgactacctagatgtgggagacgacgtgctgttgaagcatctgcagcgccagtgcgctattatctgcgacgcgttgcaagagcgcagcgatgtgcccctcgccatagcggatgttagccttgcctacgaacgccacctgttctcaccgcgtgtaccccccaaacgacaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcattgtggagtgctggtggaacttgagggtgacaacgcgcgcctagccgtgctaaaacgcagcatcgaggtcacccactttgcctacccggcacttaacctaccccccaaggttatgagcacagtcatgagcgagctgattgtgcgccgtgcacaacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttactgacccgaagatgcagcgcaagctagaggaaacattgcactacacctttcgccagggctacgtgcgccaggcctgcaaaatttccaacgtggagctctgcaacctggtctcctaccttggaattttgcacgaaaaccgcctcgggcaaaacgtgcttcattccacgctcaagggcgaggcgcgccgcgactacgtccgcgactgcgtttacttatttctatgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaatcctgcccgccacctgctgtgcgcttcctagcgactttgtgcccattaagtaccgtgaatgccctccgccgctttggggtcactgctaccttctgcagctagccaactaccttgcctaccactccgacatcatggaagacgtgagcggtgacggcctactggagtgtcactgtcgctgcaacctatgcaccccgcaccgctccctggtctgcaattcgcagctgcttagcgagagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcccaatgcggagcttaccgcctgcgtcattacccagggccacatccttggccaattgcaagccatcaacaaagcccgccaagagtttctgctacgaaagggacggggggtttacttggacccccagtccggcgaggagctcaacccaattcccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggccgaagaggtgtcagacgaaacaccgtcaccctcggtcgcattcccctcgccggcgccccagaaatcggcaaccggtccaagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcgtggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctaaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccactatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctcgcttggtctccgtccggacgggacatttcagatcggcggtgccggccgctcttcatttacgccccgtcaggcgatcttaactctgcaaacctcatcctcggagccgcgctccggaggcattggaactctacaatttattgaggagttcgtgccttcggtttacttcaaccccttttctggacctcctggccactacccggaccagtttattcccaactttgacgcggtgaaggactcggcggacggctacgactgaatgactagtggagaggcagagcaactgcgcctaacacaccttgaccactgccgccgccacaagtgctttgcccgcggctccggtgagttttgttactttgagttgcccgaagagcatatcgagggcccggcgcacggcgtccggctcaccacccaggtagagcttactcgtagcctaattcgggagtttaccctgcgccccctgctagtggagcgggagaggggtccctgtgttctgaccgtggtttgcaactgtcctaaccctggattacatcaagatctttgttgccatctctgtactgagtataataaatacagaaattagaatctactggggctcctgtcgctcctgtaaacgccaccgtcttcacccacccaaacctgcgatttgcacaggcgggccaaaaagtaccttgccggtacttaacggctcttcctttgtgatttacaacagtttcaaccaagacggagtgagccgcggacaacctctccgggcttatcagaaaaaatcaccctccttacctgccgggaacgtaccagtgcgtcaccggtcgccgcacccaccgcctgattgttaaccaacatttccagcaacagacctcaataattcccattttccataagaggaggtgagcttaaccccctggaagcgcatttttactgtttttaggcaaggtgtatgaactctactaactctacgggcttctctgcttcaggtaatttttctggaatcgggctcggggtcattctcactcttgtaattctctttatttttatactagcgcttctgtgtcttaggcttgccgcctgctgcgcacacgtttgcatttactgtcagcttattaaacgctggggacgccacccaagatgattaaatacatcattttaagcttgcttaccctagcggcagtctgcagtgctgccaaacaggtagagtttaaggagccagcttgcaatgttacatttaaatccgaagctaatgaatgcaccactcttataaaatgcaccacagaacatgaaaagcttattattcgccacaaagacaaagctggcaagtatgctgtatatgctatttggcagcctggagaccctaacaactataatgttacagtttttcagggtaatgattctaaagtttttttgtatgaatttccattttatgaaatgtgtgacattaccatgtacatgagcaaacagtataagttgtggcccccacaaaagtgtgtggagaacactggcactttttgctttactgctctcctgattacagtgattactttggtgtgtaccctcctttatattaaatttaaaagcagacgcagctttattgaagaaaagaaaatgccttagcatgctgccgccgcttcttgcttgcattgcaaaacagcttacaaccttagcattataatagcatgtcttgcaacgcccccctcaaagctccccactttaccctgcttaatgtcattcccatggacaatggactctgtggaatatgtgccaggttggcaaggcaagacacacgcctacaaccttaaagtcaggctttcctggactgagagcgcctgacttcaacagcacctgccccgtggagttcatccagcaacttcagcagcccgccttcgacatggtcgacacagtgaactcttacaacaccgctaccggactcacatctacccaagatatgccccaagtttctacctttgttaataattgggcaaacttgggcatgtggtggttttcaatagcgcttatgtttgtctgccttattattatgtggctttcctgctgcctaaagcgcaaacgcgcccgaccacccatttataagcccattattgtgcttaacccaaacaatgatggaatacatagattggacgggctgaacacttgttctttttcttttgcagtatgattaaatgagacatgattcctcgagtttttatattattgacccttattgcgcttttctgcgcgtgctccacattggccgcggttgctaacatcgaagtagactgcattccagccttcacagtctacctgctttacggatttgtcacccttacgctcatctgcagcctcatcactgtagtgatcgcctttattcaatgcattgactgggtctgtgtgcgcattgcataccttagacaccatcctcaatacagagacacggccatagctgagcttcttagaattctttaattatgaaaattacttggattttcttactaattttttacaccttaactgtggtttgctcccagacctccaagcctccccaaagacatgtatcttgcagatttactcgtatatggaacattccaagttgctacactgaaaaaagcgacctgtccgaaacctggttgtatgccatcatctcggtttttgtattttgtagcaccataattgcactagccatatacccctacctggatattggatggaacgccatagacgccatgagccattccactttccccgcgcccgctataattcagatgcagccaattgttgccggcggcattgtcccagccaatcagcatcgccctccttctcccactcccactgagattagctactttaatctaacaggcggagatgactgacggcctagatctagaaatggacggaattattaccgagcagcgtctgctacagaggcgcaaagcagcggcagagcaggaacgcctaaatcaggagctccaagacatggttaacctgcaccagtgtaaaagaggtattttttgtctggttaagcaggcaaaagttacctacgagaaggaccacagcaaccaccgccttagctacaagctgcccgccaagcgccaaaaactgctgcttatggtgggagaaaggcccatcaccgtcactcagcagtcagtagaaactgagggctgtctgcacttcccctgccagggtccagaggacctttgcacccttattaagactttatgcggtcttagagatcttattccctttaactaataaacaatacaataaatgtaatcaataaagaatcacttacttaaaatcacttagcagatctttatccaatttattcagcagcacctcctttccctcctcccaactctggtacctcagtcgtcttctagctgcaaactttctccacagtttaaatgggatgtcagattcctcttgttcctgcccctccgcacccactattttcatgttgttgcagatgaagcgcgccagaccgtctgaagacaccttcaaccccgtgtacccttatgacacggaaaccggccccccaacagtgcctttccttacccctccctttgtctcccccaatgggttccaagaaagtccccctggggtgctttctctgcgcctttccgaaccactcgtcacctcccacggcatgcttgcgctcaaaatgggcagcggcctagccctggacaaggccggcaaccttacatcacaaaatataaccaccgtcactgagccattaaaaaaaacaaagtccaacataagcctggaaacctccgcgcccctcacagttacatcaggcattcttaccgtagccactgccgcacctttggtggtcgcgggcaacagtcttaccgtgcagtcacaggccccgttaaccgtgcaagactctaaacttagcattgccaccaaaggacccctcacagtgtcagaaggaaagctggccctgcaaacatcgggccccctttctgccactgataacaacacccttactattactacttcaccccctataactactacaaatggtagtttgggtgttaacatggaaaacccactttacaacaacaatggcaaactggggctcagagttgcaggtcctttgcaagtgaccaacgactctcacgcactaacagtaggtacaggtcagggtgttgccattgataataatgcgctacacacaaaagttacaggcgcaatagggtatgatacatctggtaacatggaacttaaaactggagggggagtgcgtgtagacagtgtaaataggcgtcttatactcgatgttgattatccatttgatgcccaaagccaactacgcctaaaactaggacagggacccctatatgtaaactcaagcacacacaacttggatttaaactacaataaaggccttcacttgtttacaactggaaactctaaaaagctagaagtaaatcttaaaacaacaaagggtcttatttttgacaccgatgctgttgcaatacatgcagcacaaggtctagaatttggtaatgatacgtcaacaaatacaaacccacttaaaacaaaactaggattgggattggactatgactcaaacggtggtatgattcccaaacttggaacaggccttagttttgatactacaggggctataacagtgggaaacaaaagcgatgacaaacttaccctgtggacaactcctgacccatcacctaattgtcaaatacactcagaaaaagatgctaagctaacactagttttaactaaatgcggcagtcaggtacttgcaactgtgtcagcactggctgtaaggggcagcctagctcctattagcggaacaataagtagtgctcacattattctcagatttaatgaacatggagtgctaatgaatcattctagtttggatccccaatactggaatttcagaaaaggggatttaacaaacgctacagcatatactaacgcagttggttttatgcccaaccttaaagcttacccaaaaactcaaagtagaactgcaaaaagcaacattgttagtcaggtttatcttaatggagaaaaagaaaaaccaatgacactcactattacacttaatggaactgatgaaaatcaaaccactcccgccagtacatactcaatttcattttcatggagctggcctagcaatcaaacatacattggtcaaacatttgccactaattcctacaccttctcctacattgcccaagaataaagaatcgttgtgttatgtttcaacgtgtttatttttcaattgcaaaaaatttcaagtcatttttcattcagtagtatagccccaccaccacatagcttatattgatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctctcttaagttcatgttgctgtccagctgctgagccacaggctgctgtccaacttgcggttgctcaacgggcggcgaaggggaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataagacgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcaaggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcagggtgaatctcctctataaacattccagcaccttcaaccatgcccaaataattttcatctcgccaccttatcaatatgtctctaagtaaatcccgaatattaagtccggccattgtaaaaatctgctccagagcaccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaacacccagaaaaccgcacgcgaacctacgcccagaaacgaaagccaaaaaacccacaacttcctcaaatcttcacttccgttttcccacgatacgtcacttcccattttaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatgatttaaa

SEQ ID NO: 15 - DNA, 35952 bp, Adenovirus C2
  MISC_FEATURE (1)..(35952): Complete Genome
tttaaatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgccggatgtggtaaaagtgacgtttttggtgtgcgccggtgtatacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaatttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgcttcatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggattttgatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgaacagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaaaagtatctttcccgcgcgaggcataaagttgcgtgtgatgcggaagggtcccggcacctcggaacggttgttaattacctgggcggcgagcacgatctcgtcgaagccgttgatgttgtggcccacgatgtaaagttccaagaagcgcggggtgcccttgatggagggcaattttttaagttcctcgtaggtgagctcctcaggggagctgagcccgtgttctgacagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccacggctaggtctcgcgcggcggtcaccagaggctcatctccgccgaacttcataaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttatggtggatcggaccaccacgccgcgcgagcccaaagtccagatgtccgcgcgcggcggtcggagcttgatgacaacatcgcgcagatgggagctgtccatggtctggagctcccgcggcgacaggtcaggcgggagctcctgcaggtttacctcgcatagccgggtcagggcgcgggctaggtccaggtgatacctgatttccaggggctggttggtggcggcgtcgatgacttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatttcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcaatctcctcttccataagggcctccccttcttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctacggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactgatatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtgaggcgtgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggctgctgcgctagcttttttggccactggccgcgcgcggcgtaagcggttaggctggaaagcgaaagcattaagtggctcgctccctgtagccggagggttattttccaagggttgagtcgcaggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctccccttctcctaccgcgtcaggaggggcaacatccgcggctgacgcggcggcagatggtgattacgaacccccgcggcgccgggcccggcactacctggacttggaggagggcgagggcctggcgcggctaggagcgccctctcctgagcgacacccaagggtgcagctgaagcgtgacacgcgcgaggcgtacgtgccgcggcagaacctgtttcgcgaccgcgagggagaggagcccgaggagatgcgggatcgaaagttccacgcagggcgcgagttgcggcatggcctgaaccgcgagcggttgctgcgcgaggaggactttgagcccgacgcgcggaccgggattagtcccgcgcgcgcacacgtggcggccgccgacctggtaaccgcgtacgagcagacggtgaaccaggagattaactttcaaaaaagctttaacaaccacgtgcgcacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacattctgcagagcatagtggtgcaggagcgcagcttgagcctggctgacaaggtggccgccattaactattccatgctcagtctgggcaagttttacgcccgcaagatataccataccccttacgttcccatagacaaggaggtaaagatcgaggggttctacatgcgcatggcgttgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgtaaccctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgatgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtccgggccagactattttttccagaccagtagacaaggcctgcagaccgtaaacctgagccaggctttcaagaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctgaactacctgctgaccaaccggcggcagaagatcccctcgttgcacagtttaaacagcgaggaggagcgcatcttgcgctatgtgcagcagagcgtgagccttaacctgatgcgcgacggggtaacgcccagcgtggcgctggacatgaccgcgcgcaacatggaaccgggcatgtatgcctcaaaccggccgtttatcaatcgcctaatggactacttgcatcgcgcggccgccgtgaaccccgagtatttcaccaatgccatcttgaacccgcactggctaccgccccctggtttctacaccgggggatttgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgcgagtagcccatttccaagcttgatagggtcttttaccagcactcgcaccacccgcccgcgcctgctgggcgaggaggagtacctaaacaactcgctgctgcagccgcagcgcgaaaagaacctgcctccggcatttcccaacaacgggatagagagcctagtggacaagatgagtagatggaagacgtatgcgcaggagcacagggatgtgcccggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaaaaagcatgatgcaaaataaaaaactcaccaaggccatggcaccgagcgttggttttcttgtattccccttagtatgcagcgcgcggcgatgtatgaggaaggtcctcctccctcctacgagagcgtggtgagcgcggcgccagtggcggcggcgctgggttcccccttcgatgctcccctggacccgccgtttgtgcctccgcggtacctgcggcctaccggggggagaaacagcatccgttactctgagttggcacccctattcgacaccacccgtgtgtaccttgtggacaacaagtcaacggatgtggcatccctgaactaccagaacgaccacagcaactttctaaccacggtcattcaaaacaatgactacagcccgggggaggcaagcacacagaccatcaatcttgacgaccgttcgcactggggcggcgacctgaaaaccatcctgcataccaacatgccaaatgtgaacgagttcatgtttaccaataagtttaaggcgcgggtgatggtgtcgcgctcgcttactaaggacaaacaggtggagctgaaatatgagtgggtggagttcacgctgcccgagggcaactactccgagaccatgaccatagaccttatgaacaacgcgatcgtggagcactacttgaaagtgggcaggcagaacggggttctggaaagcgacatcggggtaaagtttgacacccgcaacttcagactggggtttgacccagtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgacctggagggtggtaacattcccgcactgttggatgtggacgcctaccaggcaagcttaaaagatgacaccgaacagggcggggatggcgcaggcggcggcaacaacagtggcagcggcgcggaagagaactccaacgcggcagccgcggcaatgcagccggtggaggacatgaacgatcatgccattcgcggcgacacctttgccacacgggcggaggagaagcgcgctgaggccgaggcagcggcagaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccgggatccgctcatggaccctcctttgcactcctgacgtaacctgcggctcggagcaggtctactggtcgttgccagacatgatgcaagaccccgtgaccttccgctccacgagccagatcagcaactttccggtggtgggcgccgagctgttgcccgtgcactccaagagcttctacaacgaccaggccgtctactcccagctcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaaacatgtccatccttatatcgcccagcaataacacaggctggggcctgcgcttcccaagcaagatgtttggcggggcaaagaagcgctccgaccaacacccagtgcgcgtgcgcgggcactaccgcgcgccctggggcgcgcacaaacgcggccgcactgggcgcaccaccgtcgatgacgccattgacgcggtggtggaggaggcgcgcaactacacgcccacgccgccaccagtgtccacagtggacgcggccattcagaccgtggtgcgcggagcccggcgttatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtactgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgcaaccgcgcccaggcggcgggtacagtggaaaggtcgacgcgtaagacgtgttttgcgacccggcaccaccgtagtttttacgcccggtgagcgctccacccgcacctacaagcgcgtgtatgatgaggtgtacggcgacgaggacctgcttgagcaggccaacgagcgcctcggggagtttgcctacggaaagcggcataaggacatgttggcgttgccgctggacgagggcaacccaacacctagcctaaagcccgtgacactgcagcaggtgctgcccacgcttgcaccgtccgaagaaaagcgcggcctaaagcgcgagtctggtgacttggcacccaccgtgcagctgatggtacccaagcgccagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaaaacctctacggaggtgcaaacggacccgtggatgtttcgcgtttcagccccccggcgcccgcgccgttccaggaagtacggcaccgccagcgcactactgcccgaatatgccctacatccttccatcgcgcctacccccggctatcgtggctacacctaccgccccagaagacgagcgactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccattaagaactatggcagcaaggcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcggcccgacagggaagaaactctggtgacgcaaatagatgagcctccctcgtacgaggaggcactaaagcaaggcctgcccaccacccgtcccatcgcgcccatggctaccggagtgctgggccagcacacacctgtaacgctggacctgcctccccccgctgacacccagcagaaacctgtgctgccagggccgtccgccgttgttgtaacccgccctagccgcgcgtccctgcgccgtgccgccagcggtccgcgatcgatgcggcccgtagccagtggcaactggcaaagcacactgaacagcatcgtgggtctgggggtgcaatccctgaagcgccgacgatgcttctaaatagctaacgtgtcgtatgtgtcatgtatgcgtccatgtcgccgccagaggagctgctgagccgccgtgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcacctacgcacgacgtaaccacagaccggtcccagcgtttgacgctgcggttcatccctgtggaccgcgaggataccgcgtactcgtacaaagcgcggttcaccctggctgtgggtgacaaccgtgtgcttgatatggcttccacgtactttgacatccgcggcgtgctggacagggggcctacttttaagccctactccggcactgcctacaacgctctagctcccaagggcgctcctaactcctgtgagtgggaacaaaccgaagatagcggccgggcagttgccgaggatgaagaagaggaagatgaagatgaagaagaggaagaagaagagcaaaacgctcgagatcaggctactaagaaaacacatgtctatgcccaggctcctttgtctggagaaacaattacaaaaagcgggctacaaataggatcagacaatgcagaaacacaagctaaacctgtatacgcagatccttcctatcaaccagaacctcaaattggcgaatctcagtggaacgaagctgatgctaatgcggcaggagggagagtgcttaaaaaaacaactcccatgaaaccatgctatggatcttatgccaggcctacaaatccttttggtggtcaatccgttctggttccggatgaaaaaggggtgcctcttccaaaggttgacttgcaattcttctcaaatactacctctttgaacgaccggcaaggcaatgctactaaaccaaaagtggttttgtacagtgaagatgtaaatatggaaaccccagacacacatctgtcttacaaacctggaaaaggtgatgaaaattctaaagctatgttgggtcaacaatctatgccaaacagacccaattacattgctttcagggacaattttattggcctaatgtattataacagcactggcaacatgggtgttcttgctggtcaggcatcgcagctaaatgccgtggtagatttgcaagacagaaacacagagctgtcctatcaactcttgcttgattccataggtgatagaaccagatatttttctatgtggaatcaggctgtagacagctatgatccagatgttagaatcattgaaaaccatggaactgaggatgaattgccaaattattgttttcctcttgggggtattggggtaactgacacctatcaagctattaaggctaatggcaatggctcaggcgataatggagatactacatggacaaaagatgaaacttttgcaacacgtaatgaaataggagtgggtaacaactttgccatggaaattaacctaaatgccaacctatggagaaatttcctttactccaatattgcgctgtacctgccagacaagctaaaatacaaccccaccaatgtggaaatatctgacaaccccaacacctacgactacatgaacaagcgagtggtggctcccgggcttgtagactgctacattaaccttggggcgcgctggtctctggactacatggacaacgttaatccctttaaccaccaccgcaatgcgggcctccgttatcgctccatgttgttgggaaacggccgctacgtgccctttcacattcaggtgccccaaaagttttttgccattaaaaacctcctcctcctgccaggctcatatacatatgaatggaacttcaggaaggatgttaacatggttctgcagagctctctgggaaacgatcttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctataccccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacctttgactcttctgttagctggccgggcaacgaccgcctgcttactcccaatgagtttgagattaaacgctcagttgacggggagggctacaacgtagctcagtgcaacatgaccaaggactggttcctggtgcagatgttggccaactacaatattggctaccagggcttctacattccagaaagctacaaggaccgcatgtactcgttcttcagaaacttccagcccatgagccggcaagtggttgacgatactaaatacaaggagtatcagcaggttggaattcttcaccagcataacaactcaggattcgtaggctacctcgctcccaccatgcgcgagggacaggcttaccccgccaacgtgccctacccactaataggcaaaaccgcggttgacagtattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcgctcaaaaacatgctacctctttgagccctttggcttttctgaccaacgactcaagcaggtttaccagtttgagtacgagtcactcctgcgccgtagcgccattgcttcttcccccgaccgctgtataacgctggaaaagtccacccaaagcgtgcaggggcccaactcggccgcctgtggactattctgctgcatgtttctccacgcctttgccaactggccccaaactcccatggatcacaaccccaccatgaaccttattaccggggtacccaactccatgcttaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactaggagacactttcaataaaggcaaatgtttttatttgtacactctcgggtgattatttaccccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccggtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcgtccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgacacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaggatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaaacgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgcctcgggcaaaacgtgcttcattccacgctcaagggcgaggcgcgccgcgactacgtccgcgactgcgtttacttatttctgtgctacacctggcaaacggccatgggcgtgtggcagcaatgcctggaggagcgcaacctaaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttctgcagctagccaactaccttgcctaccactccgacatcatggaagacgtgagcggtgacggcctactggagtgtcactgtcgctgcaacctatgcaccccgcaccgctccctggtctgcaattcgcaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccatcaacaaagcccgccaagagtttctgctacgaaagggacggggggtttacctggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaagcttccgaggccgaagaggtgtcagacgaaacaccgtcaccctcggtcgcattcccctcgccggcgccccagaaattggcaaccgttcccagcatcgctacaacctccgctcctcaggcgccgccggcactgcctgttcgccgacccaaccgtagatgggacaccactggaaccagggccggtaagtctaagcagccgccgccgttagcccaagagcaacaacagcgccaaggctaccgctcgtggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcggcagcaacagcagcggtcacacagaagcaaaggcgaccggatagcaagactctgacaaagcccaagaaatccacagcggcggcagcagcaggaggaggagcgctgcgtctggcgcccaacgaacccgtatcgacccgcgagcttagaaataggatttttcccactctgtatgctatatttcaacaaagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtgaaagactcggcggacggctacgactgaatgaccagtggagaggcagagcgactgcgcctgacacacctcgaccactgccgccgccacaagtgctttgcccgcggctccggtgagttttgttactttgaattgcccgaagagcatatcgagggcccggcgcacggcgtccggctcaccacccaggtagagcttacacgtagcctgattcgggagtttaccaagcgccccctgctagtggagcgggagcggggtccctgtgttctgaccgtggtttgcaactgtcctaaccctggattacatcaagatctttgttgtcatctctgtgctgagtataataaatacagaaattagaatctactggggctcctgtcgccatcctgtgaacgccaccgtttttacccacccaaagcagaccaaagcaaacctcacctccggtttgcacaagcgggccaataagtaccttacctggtactttaacggctcttcatttgtaatttacaacagtttccagcgagacgaagtaagtttgccacacaaccttctcggcttcaactacaccgtcaagaaaaacaccaccaccaccaccctcctcacctgccgggaacgtacgagtgcgtcaccggttgctgcgcccacacctacagcctgagcgtaaccagacattactcccatttttccaaaacaggaggtgagctcaactcccggaactcaggtcaaaaaagcattttgcggggtgctgggattttttaattaagtatatgagcaattcaagtaactctacaagcttgtctaatttttctggaattggggtcggggttatccttactcttgtaattctgtttattcttatactagcacttctgtgccttagggttgccgcctgctgcacgcacgtttgtacctattgtcagctttttaaacgctgggggcaacatccaagatgaggtacatgattttaggcttgctcgcccttgcggcagtctgcagcgctgccaaaaaggttgagtttaaggaaccagcttgcaatgttacatttaaatcagaagctaatgaatgcactactcttataaaatgcaccacagaacatgaaaagcttattattcgccacaaagacaaaattggcaagtatgctgtatatgctatttggcagccaggtgacactaacgactataatgtcacagtcttccaaggtgaaaatcgtaaaacttttatgtataaatttccattttatgaaatgtgcgatattaccatgtacatgagcaaacagtacaagttgtggcccccacaaaagtgtttagagaacactggcaccttttgttccaccgctctgcttattacagcgcttgctttggtatgtaccttactttatctcaaatacaaaagcagacgcagttttattgatgaaaagaaaatgccttgattttccgcttgcttgtattcccctggacaatttactctatgtgggatatgttccaggcgggcaagattatacccacaaccttcaaatcaaactttcctggacgttagcgcctgatttctgccagcgcctgcactgcaaatttgatcaaacccagcttcagcttgcctgctccagagatgaccggctcaaccatcgcgcccacaacggactatcgcaacaccactgctaccggactaacatctgccctaaatttaccccaagttcatgcctttgtcaatgactgggcgagcttggacatgtggtggttttccatagcgcttatgtttgtttgccttattattatgtggcttatttgttgcctaaagcgcagacgcgccagaccccccatctataggcctatcattgtgctcaacccacacaatgaaaaaattcatagattggacggtctgaaaccatgttctcttcttttacagtatgattaaatgagacatgattcctcgagttcttatattattgacccttgttgcgcttttctgtgcgtgctctacattggccgcggtcgctcacatcgaagtagattgcatcccacctttcacagtttacctgctttacggatttgtcacccttatcctcatctgcagcctcgtcactgtagtcatcgccttcattcagttcattgactgggtttgtgtgcgcattgcgtacctcaggcaccatccgcaatacagagacaggactatagctgatcttctcagaattctttaattatgaaacggagtgtcatttttgttttgctgattttttgcgccctacctgtgctttgctcccaaacctcagcgcctcccaaaagacatatttcctgcagattcactcaaatatggaacattcccagctgctacaacaaacagagcgatttgtcagaagcctggttatacgccatcatctctgtcatggttttttgcagtaccatttttgccctagccatatatccataccttgacattggctggaatgccatagatgccatgaaccaccctactttcccagtgcccgctgtcataccactgcaacaggttattgccccaatcaatcagcctcgccccccttctcccacccccactgagattagctactttaatttgacaggtggagatgactgaatctctagatctagaattggatggaattaacaccgaacagcgcctactagaaaggcgcaaggcggcgtccgagcgagaacgcctaaaacaagaagttgaagacatggttaacctacaccagtgtaaaagaggtatcttttgtgtggtcaagcaggccaaacttacctacgaaaaaaccactaccggcaaccgcctcagctacaagctacccacccagcgccaaaaactggtgcttatggtgggagaaaaacctatcaccgtcacccagcactcggcagaaacagagggctgcctgcacttcccctatcagggtccagaggacctctgcactcttattaaaaccatgtgtggtattagagatcttattccattcaactaacataaacacacaataaattacttacttaaaatcagtcagcaaatctttgtccagcttattcagcatcacctcctttccttcctcccaactctggtatctcagccgccttttagctgcaaactttctccaaagtttaaatgggatgtcaaattcctcatgttcttgtccctccgcacccactatcttcatattgttgcagatgaaacgcgccagaccgtctgaagacaccttcaaccccgtgtatccatatgacacagaaaccgggcctccaactgtgccctttcttacccctccatttgtttcacccaatggtttccaagaaagtccccctggagttctctctctacgcgtctccgaacctttggacacctcccacggcatgcttgcgcttaaaatgggcagcggtcttaccctagacaaggccggaaacctcacctcccaaaatgtaaccactgttactcagccacttaaaaaaacaaagtcaaacataagtttggacacctccgcaccacttacaattacctcaggcgccctaacagtggcaaccaccgctcctctgatagttactagcggcgctcttagcgtacagtcacaagccccactgaccgtgcaagactccaaactaagcattgctactaaagggcccattacagtgtcagatggaaagctagccctgcaaacatcagcccccctctctggcagtgacagcgacacccttactgtaactgcatcacccccgctaactactgccacgggtagcttgggcattaacatggaagatcctatttatgtaaataatggaaaaataggaattaaaataagcggtcctttgcaagtagcacaaaactccgatacactaacagtagttactggaccaggtgtcaccgttgaacaaaactcccttagaaccaaagttgcaggagctattggttatgattcatcaaacaacatggaaattaaaacgggcggtggcatgcgtataaataacaacttgttaattctagatgtggattacccatttgatgctcaaacaaaactacgtcttaaactggggcagggacccctgtatattaatgcatctcataacttggacataaactataacagaggcctatacctttttaatgcatcaaacaatactaaaaaactggaagttagcataaaaaaatccagtggactaaactttgataatactgccatagctataaatgcaggaaagggtctggagtttgatacaaacacatctgagtctccagatatcaacccaataaaaactaaaattggctctggcattgattacaatgaaaacggtgccatgattactaaacttggagcgggtttaagctttgacaactcaggggccattacaataggaaacaaaaatgatgacaaacttaccctgtggacaaccccagacccatctcctaactgcagaattcattcagataatgactgcaaatttactttggttcttacaaaatgtgggagtcaagtactagctactgtagctgctttggctgtatctggagatctttcatccatgacaggcaccgttgcaagtgttagtatattccttagatttgaccaaaacggtgttctaatggagaactcctcacttaaaaaacattactggaactttagaaatgggaactcaactaatgcaaatccatacacaaatgcagttggatttatgcctaaccttctagcctatccaaaaacccaaagtcaaactgctaaaaataacattgtcagtcaagtttacttgcatggtgataaaactaaacctatgatacttaccattacacttaatggcactagtgaatccacagaaactagcgaggtaagcacttactctatgtcttttacatggtcctgggaaagtggaaaatacaccactgaaacttttgctaccaactcttacaccttctcctacattgcccaggaataaagaatcgtgaacctgttgcatgttatgtttcaacgtgtttatttttcaattgcagaaaatttcaagtcatttttcattcagtagtatagccccaccaccacatagcttatattgatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcgcttaagttcatgtcgctgtccagctgctgagccacaggctgctgtccaacttgcggttgctcaacgggcggcgaaggggaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcatgagacgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcagggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagcccctatgtaagcttgttgcatgggcggcgatataaaatgcaaggtgctgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcattaaacacaaaataaaataacaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaacacccagaaaaccgcacgcgaacctacgcccagaaacgaaagccaaaaaacccacaacttcctcaaatcttcacttccgttttcccacgatacgtcacttcccattttaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatgttaattaa

SEQ ID NO: 16 - DNA, 35949 bp, Adenovirus C5
  MISC_FEATURE (1)..(35949): Complete Genome
ttaattaacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgctttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgatttaaa

SEQ ID NO: 17 - DNA, 35776 bp, Adenovirus C6
  MISC_FEATURE (1)..(35776): Complete Genome
ttttaaatcatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctccccttctcctaccgcgtcaggaggggcaacatccgcggctgacgcggcggcagatggtgattacgaacccccgcggcgccggacccggcactacttggacttggaggagggcgagggcctggcgcggctaggagcgccctctcctgagcgacacccaagggtgcagctgaagcgtgacacgcgcgaggcgtacgtgccgcggcagaacctgtttcgcgaccgcgagggagaggagcccgaggagatgcgggatcgaaagttccatgcagggcgcgagttgcggcatggcctgaaccgcgagcggttgctgcgcgaggaggactttgagcccgacgcgcggaccgggattagtcccgcgcgcgcacacgtggcggccgccgacctggtaaccgcgtacgagcagacggtgaaccaggagattaactttcaaaaaagctttaacaaccacgtgcgcacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacattctgcagagcatagtggtgcaggagcgcagcttgagcctggctgacaaggtggccgccattaactattccatgctcagtctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaaccctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgatgaggccggcctggtctacgacgcgctgcttcagcgcgtggctcgttacaacagcagcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtatcagtccgggccagactattttttccagaccagtagacaaggcctgcagaccgtaaacctgagccaggctttcaagaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgttagccgcgcgctggggcaggaggacacgggcagcctggaggcaaccctgaactacctgctgaccaaccggcggcaaaaaatcccctcgttgcacagtttaaacagcgaggaggagcgcattttgcgctatgtgcagcagagcgtgagccttaacctgatgcgcgacggggtaacgcccagcgtggcgctggacatgaccgcgcgcaacatggaaccgggcatgtatgcctcaaaccggccgtttatcaatcgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacaacgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaagaacctgcctccggcgtttcccaacaacgggatagagagcctagtggacaagatgagtagatggaagacgtatgcgcaggagcacagggatgtgcccggcccgcgcccgcccacccgtcgtcaaaggcacgaccgtcagcggggtctggtgtgggaggacgatgactcggcagacgacagcagcgtcttggatttgggagggagtggcaacccgtttgcacaccttcgccccaggctggggagaatgttttaaaaaaagcatgatgcaaaataaaaaactcaccaaggccatggcaccgagcgttggttttcttgtattccccttagtatgcggcgcgcggcgatgtatgaggaaggtcctcctccctcctacgagagcgtggtgagcgcggcgccagtggcggcggcgctgggttcacccttcgatgctcccctggacccgccgttcgtgcctccgcggtacctgcggcctaccggggggagaaacagcatccgttactctgagttggcacccctattcgacaccacccgtgtgtaccttgtggacaacaagtcaacggatgtggcatccctgaactaccagaacgaccacagcaactttctaaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgctcgcttactaaggacaaacaggtggagctgaaatacgagtgggtggagttcacgctgcccgagggcaactactccgagaccatgaccatagaccttatgaacaacgcgatcgtggagcactacttgaaagtgggcaggcagaacggggttctggaaagcgacatcggggtaaagtttgacacccgcaacttcagactggggtttgacccagtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgacctggagggtggtaacattcccgcactgttggatgtggacgcctaccaggcaagcttgaaagatgacaccgaacagggcgggggtggcgcaggcggcggcaacaacagtggcagcggcgcggaagagaactccaacgcggcagctgcggcaatgcagccggtggaggacatgaacgatcatgccattcgcggcgacacctttgccacacgggcggaggagaagcgcgctgaggccgaggcagcggccgaagctgccgcccccgctgcggaggctgcacaacccgaggtcgagaagcctcagaagaaaccggtgattaaacccctgacagaggacagcaagaaacgcagttacaacctaataagcaatgacagcaccttcacccagtaccgcagctggtaccttgcatacaactacggcgaccctcaggccgggatccgctcatggaccctgctttgcactcctgacgtaacctgcggctcggagcaggtatactggtcgttgcccgacatgatgcaagaccccgtgaccttccgctccacgcgccagatcagcaactttccggtggtgggcgccgagctgttgcccgtgcactccaagagcttctacaacgaccaggccgtctactcccagctcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgctatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgcgtccctgcgccgcgccgccagcggtccgcgatcgttgcggcccgtagccagtggcaactggcaaagcacactgaacagcatcgtgggtttgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagttcgcccgcgccaccgagacgtacttcagcctgaataacaagtttagaaaccccacggtggcgcctacgcacgacgtgaccacagaccggtctcagcgtttgacgctgcggttcatccccgtggaccgcgaggatactgcgtactcgtacaaggcgcggttcaccctagctgtgggtgataaccgtgtgctagacatggcttccacgtactttgacatccgcggcgtgctggacaggggccctacttttaagccctactctggcactgcctacaacgcactggcccccaagggtgcccccaactcgtgcgagtgggaacaaaatgaaactgcacaagtggatgctcaagaacttgacgaagaggagaatgaagccaatgaagctcaggcgcgagaacaggaacaagctaagaaaacccatgtatatgcccaggctccactgtccggaataaaaataactaaagaaggtctacaaataggaactgccgacgccacagtagcaggtgccggcaaagaaattttcgcagacaaaacttttcaacctgaaccacaagtaggagaatctcaatggaacgaagcggatgccacagcagctggtggaagggttcttaaaaagacaactcccatgaaaccctgctatggctcatacgctagacccaccaattccaacggcggacagggcgttatggttgaacaaaatggtaaattggaaagtcaagtcgaaatgcaatttttttccacatccacaaatgccacaaatgaagttaacaatatacaaccaacagttgtattgtacagcgaagatgtaaacatggaaactccagatactcatctttcttataaacctaaaatgggggataaaaatgccaaagtcatgcttggacaacaagcaatgccaaacagaccaaattacattgcttttagagacaattttattggtctcatgtattacaacagcacaggtaacatgggtgtccttgctggtcaggcatcgcagttgaacgctgttgtagatttgcaagacagaaacacagagctgtcctaccagcttttgcttgattcaattggcgacagaacaagatacttttcaatgtggaatcaagctgttgacagctatgatccagatgtcagaattattgagaaccatggaactgaggatgagttgccaaattattgctttcctcttggtggaattgggattactgacacttttcaagctgttaaaacaactgctgctaacggggaccaaggcaatactacctggcaaaaagattcaacatttgcagaacgcaatgaaataggggtgggaaataactttgccatggaaattaacctgaatgccaacctatggagaaatttcctttactccaatattgcgctgtacctgccagacaagctaaaatacaaccccaccaatgtggaaatatctgacaaccccaacacctacgactacatgaacaagcgagtggtggctcctgggcttgtagactgctacattaaccttggggcgcgctggtctctggactacatggacaacgttaatccctttaaccaccaccgcaatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcagatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttctgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgaatgaccagtggagaggcagagcaactgcgcctgacacacctcgaccactgccgccgccacaagtgctttgcccgcggctccggtgagttttgttactttgaattgcccgaagagcatatcgagggcccggcgcacggcgtccggctcaccacccaggtagagcttacacgtagcctgattcgggagtttaccaagcgccccctgctagtggagcgggagcggggtccctgtgttctgaccgtggtttgcaactgtcctaaccctggattacatcaagatctttgttgtcatctctgtgctgagtataataaatacagaaattagaatctactggggctcctgtcgccatcctgtgaacgccaccgtttttacccacccaaagcagaccaaagcaaacctcacctccggtttgcacaagcgggccaataagtaccttacctggtactttaacggctcttcatttgtaatttacaacagtttccagcgagacgaagtaagtttgccacacaaccttctcggcttcaactacaccgtcaagaaaaacaccaccaccaccctcctcacctgccgggaacgtacgagtgcgtcaccggttgctgcgcccacacctacagcctgagcgtaaccagacattactcccattttcccaaaacaggaggtgagctcaactcccggaactcaggtcaaaaaagcattttgcggggtgctgggattttttaattaagtatatgagcaattcaagtaactctacaagcttgtctaatttttctggaattggggtcggggttatccttactcttgtaattctgtttattcttatactagcacttctgtgccttagggttgccgcctgctgcacgcacgtttgtacctattgtcagctttttaaacgctgggggcgacatccaagatgaggtacatgattttaggcttgctcgcccttgcggcagtctgcagcgctgccaaaaaggttgagtttaaggaaccagcttgcaatgttacatttaaatcagaagctaatgaatgcactactcttataaaatgcaccacagaacatgaaaagcttattattcgccacaaagacaaaattggcaagtatgctgtatatgctatttggcagccaggtgacactaacgactataatgtcacagtcttccaaggtgaaaatcgtaaaacttttatgtataaatttccattttatgaaatgtgcgatattaccatgtacatgagcaaacagtacaagttgtggcccccacaaaagtgtttagagaacactggcaccttttgttccaccgctctgcttattacagcgcttgctttggtatgtaccttactttatctcaaatacaaaagcagacgcagttttattgatgaaaagaaaatgccttgattttccgcttgcttgtattcccctggacaatttactctatgtgggatatgcgccaggcgggaaagattatacccacaaccttcaaatcaaactttcctggacgttagcgcctgacttctgccagcgcctgcactgcaaatttgatcaaacccagcttcagcttgcctgctccagagatgaccggctcaaccatcgcgcccacaacggactatcgcaacaccactgctaccggactaaaatctgccctaaatttaccccaagttcatgcctttgtcaatgactgggcgagcttgggcatgtggtggttttccatagcgcttatgtttgtttgccttattattatgtggcttatttgttgcctaaagcgcagacgcgccagaccccccatctataggcctatcattgtgctcaacccacacaatgaaaaaattcatagattggacggtctcaaaccatgttctcttcttttacagtatgattaaatgagacatgattcctcgagtccttatattattgacccttgttgcgcttttctgtgcgtgctctacattggctgcggtcgctcacatcgaagtagattgcatcccacctttcacagtttacctgctttacggatttgtcacccttatcctcatctgcagcctcgtcactgtagtcatcgccttcattcagttcattgactggatttgtgtgcgcattgcgtaccttaggcaccatccgcaatacagagacaggactatagctgatcttctcagaattctttaattatgaaacggattgtcacttttgttttgctgattttctgcgccctacctgtgctttgctcccaaacctcagcgcctcccaaaagacatatttcctgcagattcactcaaatatggaacattcccagctgctacaacaaacagagcgatttgtcagaagcctggttatacgccatcatctctgtcatggttttttgcagtaccatttttgccctagccatatacccataccttgacattggttggaatgccatagatgccatgaaccaccctactttcccagcgcccaatgtcataccactgcaacaggttattgccccaatcaatcagcctcgccccccttctcccacccccactgagattagctactttaatttgacaggtggagatgactgaatctctagatctagaattggatggaattaacaccgaacagcgcctactagaaaggcgcaaggcggcgtccgagcgagaacgcctaaaacaagaagttgaagacatggttaacctgcaccagtgtaaaagaggtatcttttgtgtggtcaagcaggccaaacttacctacgaaaaaaccactaccggcaaccgccttagctacaagctacccacccagcgccaaaaactggtgcttatggtgggagaaaaacctatcaccgtcacccagcactcggcagaaacagaaggctgcctgcacttcccctatcagggtccagaggacctctgcactcttattaaaaccatgtgtggcattagagatcttattccattcaactaacaataaacacacaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcagggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatgttaattaa

SEQ ID NO: 18 - DNA, 31646 bp, Adenovirus D8
  MISC_FEATURE (1)..(31646): Complete Genome
cgatcgcgtttaaacaagggcgaattccagcacactggcggccgttactagtggatccgagctcggtaccaagcttgatgcatagcttgagtattctatagtgtcacctaaatagcttggcctatctatataatataccccacaaagtaaacaaaagttaatatgcaaatgagcttttaaattttaacggttttagggcagggccaacgttaagtggttaacaagcggtaatgcagttgacgtcaagacatcatcataatataccccacaaagtaaacaaaagttaatatgcaaatgagcttttaaattttaacggttttagggcagggccaacgttaagtggttaacaagcggtaatgcagttgacgtcaagacatcatcataatataccccacaaagtaaacaaaagttaatatgcaaatgagcttttaaattttaacggttttagggcagggccaacgttaagtggttaacaagcggtaatgcagttgacgtcaagacgtacggccggcggttgccgcaaaggcgtggcccaacccggaagcaagtcgcggggccgatgacgtataaaaaagtggactttaaacccggaaacggccgattttcccacggccacgcccggatatgaggtaattttgggcggttgcaaataaaattaggacatggtggcgccaaaactgaatgaggaagtgaaaagcgaaaaataccggtcccgcccagggcggaatatttaccgagggccaacagactttgaccgattacgtggggtttcgattacggtgtttttttttcgccaatttccgcgtccgtgttaaatccggtgtttatgttacacatcagctgatccacagggtatttaaaccagttaagcccgtcaagagactactcttgagtgccagcgagtagagttttctctaaactttgcttttaaagtttaagaaaaatgagacacctgcacctcctgtcttcaactgtgcctattgacatggccgcattattgctggaggactatgtaaatacaatattggaggacgaactgcatttatctccgtttgagctgggacccacacttcaggacctatatgatttggaggtaaatgcccaggagaacgacccaaacgaagaggctgtgaatttaatatttccagaatctatgattcttcaggctgacatagccagcgaagctgtacctacttcagtttatacaccgactctgccgcctatacctaaattggaagaggaggataagctagaccttcggtgttatgaggaaggttttcctcccagcgattcagaggacgaacggggtgagcagagcatggctataatctcagactatgcgtgtgtggttgtggaaaatcattttgtgttggacaatcctgaggtgccagggcaaggctgtaaatcctgtcaatatcaccgggaacagaccggagacccaaatgcttcctgcgctctgtgttacatgaaaatgagcttcagctttatttacagtaagtggagtaaatgtaagagaggctaagtgcttaagacattactgtgctttacttgaacagctgtactaagtgtggtttatttttggtactaggtccggtgtcagaggatgagtcatcacctttagaagaagaccacccgtctccccctgatcttacaaatgacacgcccctgcaagtgcgcagacccaccccggttagaccgagtggcgagaggcgagcggctgtttacaaaattgaggatttgttgcaggacgtgggtgggaatgaacctttgaacctgagcttgaaacgccccaggaactaggcgcagctgtgcttagtcatgtgtaaataaagttgtgcaataaaagtatgtgtgacgcatgcaaggtgtggtttatgactcatgggcggggcttagtcctatataagtggtaacacctgggcacttaggcacaaacgttaggaaattcctaatggatgtgtggagtattcttggggaatttaacaagacacgccggcttgtggaggatagttcagacgggtgctccgggttttggagacactggtttggaactcctctatctcgcctggtgtacacagttaagaaggattatagcgaggaatttgaaaatctttttgccgactgctctggcctgctagattctttaaattttggccaccagtcccttttccaggaaagggtactccacagccttgatttttccagcccagggcgcactacagccggggttgcttttgtggtttttttggttgacaaatggagccaggacacccaactaagcaggggctacattctggactttgcagccatgcacctgtggagggcctggatgaggcagcggggacagagaatcttgaactactggcttctacagccagcagcttcgggtcttcttcatctacacagacaaacatccatgttggaggaagaaatgagggaggccatggacaagaacccgaggagcggcctggaccctccgtcggaagaggagctggattaaatgaggtatccagcctatacccagagcttagcaaggtgctgacatccatggccaggggagtgaagagggagaggagcgatgggggcaatactgggctgatgacccagctaactgccagcctgatgaatcgcaagcgcccagagcgtattacctggcacgagctacagcaggagtgcagggatgagataggcctgatgcaggataaatatggcctggagcaaataaaaacccattggttgaacccagacgaggattgggaggaggccattaagaaatatgccaagatagccctgcgcccagattgcaagtacagggtgactaagaccgtgaatattaaacatgcctgctacatctcggggaacggggcagaggtggacatcgatactctggacaagtcagccttcaggtgttgcatgatgggaatgagagcaggagtaatgaatatgaattccatgatctttataaacataaagttcaatggagagaagtttaatggggtactgtttatggccaacagccacatgaccctgcatggttgcagtttttttggctttaacaatatgtgtgcagaggtctggggtgctgctaagattaggggatgtaagttttacggctgctggatgggcgtggttggaagacccaagagcgagatgtctgtaaagcagtgtgtgtttgaaaaatgctacctgggagtctgtaccgagggcaatgctagagtaagacactgctcttccctagagacgggctgcttttgcctggtgaagggcacagcctcgattaagcataatgtggtaaagggctgcacggatgagcgcatgtacaacatgctgacctgcgactcgggggtctgccatatcctgaagaacatccatgtgacctcccaccccagaaaaaagtggccagtgtttgagaataacctgctgattaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcggtggcagacacaccaggatgcagccagtggccctggatgtgaccgaggagctgcgaccagaccacctggtgatggcctgtaccgggaccgagttcagctccagtggggaggacacagattagaggtaggtttaagtagtgggcgtggctaaggtaagtataaaggcgggtgtcttacaagggtctttttgcttttctgcagacatcatgaacgggaccggcggggcctttgaaggggggctttttagcccttatttgacaacccgcctgccgggatgggccggagttcgtcagaatgtgatgggatcaacggtggacgggcgcccagtgcttccagcaaattcctctaccatgacctacgcgaccgtggggacgagctcgtcgcttgacagcaccgccgcagccgcggcagccgcagccgccatgacagcgacgagactggcctcgagctacatgcccagcagcggtagcagcccctccatccccagttccatcatcgccgaggagaaactgctggccctgctggctgagctggaagccctgagccgccagctgaccgccctgacccaggaggtgtccgagctccgcgaacagcagcagcagcaaaataaatgatttaataaacacagattttgattcaaacagcaaagcatctttattatttattttttcgcgcgcggtaggccctggtccacctctcccgatcattaagagtgcggtggattttttccaggacccggtagaggtgggattggatgttgaggtacatgggcataagcccgtcccgggggtggaggtagcaccactgcatggcctcgtgttctggggttgtgttgtagatgatccagtcatagcaggggcgctgggcgtggtgctggatgatgtccttaaggaggagactgatggccacggggagccccttggtgtaggtgttggcaaagcggttgagctgggagggatgcatgcggggggagatgatgtgtagtttggcctggatcttaaggttggcgatgttaccgcccagatcccgccgggggttcatgttgtgcaggaccaccaggacggtgtagcccgtgcacttggggaacttgtcatgcaacttggaagggaaagcgtggaagaatttggagacgcccttgtgcccgcccaggttttccatgcactcatccatgatgatggcaatgggcccgtgggctgcggctttggcaaagacgtttctggggtcagagacatcgtaattatgctcttgggtgagatcatcataagacattttaatgaatttggggcggagggtgccagattgtgggacgatggttccctcgggccccggggcgaagttcccctcgcagatctgcatctcccaggctttcatctcggagggggggatcatgtccacctgcggggcgatgaaaaaaatggtttccggggcgggggtgatgagctgcgaggagagcaggtttcttaacagctgggacttgccgcacccggttgggccgtagatgaccccgatgacgggttgcaggtggtagttcaaggagatgcagctgccgtcgtcccggaggaggggggctacctggttaagcatgtctctgacttggaggttttcccgaacaagctcgctaaggaggcggtccccgcccagcgagagcagttcttgcagggaagcaaagttttttaggggcttaagcccgtcggccatgggcatcttggcgagggtgtgcgagaggagctccaggcggtcccacagctcggtgacgtgctctacggcatctggatccagcagacttcctcgtttcgggggttgggacgactgcgactgtagggcacaagacgatgggcgtccagcgcaaccagcgtcatgtccttccagggtctcagggtccgcgtgagggtggtctccgtcacggtgaaggggtgggccccgggctgggcgcttgcaagggtgcgcttgagactcatcctgctggtgctgaaacgggcacggtcttcgccctgcgcgtcggcaagatagcagttgaccataagctggtagttaagggtctcggcggcatggcccttggcgcggagcttgcccttggaagagcgcccacaggcgggacagaggagggattgcagggcgtagagtttaggcgcgagaaaaacggactctggggcaaaggcatccgctccgcagtggacgcagacggtctcgcactcaacaagccaggtgagctcgggctgcttggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtaaagaaactcggaccactctgagacaaaggcgcgcgtccacgccaagacaaaggaggccacgtgcgaggggtagcggtcattgtccaccagggggtccaccgtttccaccgtgtgcagacacatgtccccctcctccgcatccaagaaggtgattggcttgtaggtgtaggccacgtgaccgggggttcccgacggaggggtataaaagggggcgggtctgtgctcgtcctcactctcttccgcgtcgctgtccacgagcgtcagctgttggggtaggtattgcctctcgagagctggcatgacctcggcactcaggttgtcagtttctagaaacgaggaggatttgatgttggcctgccctgtcgcaatgcttttcaggagactttcatccatctggtcagaaaagactatttttttattgtcaagcttggtggcaaaggagccatagagggcgttggagagaagcttggcgatggatctcatggtctgatttttgtcacggtcggcgcgctccttggccgcaatgttgagctggacatattcgcgcgcaacgcacttccattcgggaaaaacagtggtgcgctcgtcgggcacaatcctgacgcgccagcctcggttatgcagggtgaccaggtccacgctggtggccacctcgccgcgcaggggttcgttggtccagcagaggcgcccgcccttgcgcgagcaaaaaggtggtaacacatcaagcaaatgctcgtcaggggggtccgcatcgatggtgaagatgcccggacagagttccttgtcaaaataatcaatttttaaggatgcatcatccaaggccatttgccacttgcgggcggccagggctcgctcgcaggggttcaggggcggaccccagggcatgggatgcgtaagcgcggaggcgtacatgccgcagatgtcatacacatagatgggctccgagaggatgccgatgtaggtgggataacagcgccccccgcggatgctggcgcgcacgtagtcatacaactcatgcgagggtgccaagaaggcggggccaagattggtacgctggggctgctcggcgcgaaagacgatctggcgaaagatggcatgcgagttggaggaaatagtgggccgttggaagatgttaaagtgggcgtggggcaggcggaccgagtcgcggataaagtgcgcgtaggagtcttgcagcttggcaaccagctcggcagtgacaaggacgtccatggcgcagtagtccagcgtttcgcggataatgtcataacccgtctgtcctttcttctcccacagctcgcggttaagggcgtactcctcgtcatccttccagtactcccggagcgggaatccttgatcgtccgcacggtaagagcccagcatgtagaaatggttaacggccttgtagggacagcagcccttctccacggggagggcgtaagcttgagcggccttgcggagcgaggtgtgcgtcagggcaaaggtgtccctgaccatgactttcaaaaactggtacttaaagtccgagtcgtcgcagccgccgtgttcccatagctcaaaatctgtgcgcttctttgagagggggttaggcagagcgaaagtgacgtcattgaagagaatcttgcctgctcgtggcatgaaattgcgggtgatacggaaagggcccgggacgcaggctcggttgttgataacctgggcggctaggacaatctcgtcaaagccgttgatgttgtgcccgacgatgtatagttccataaatcgcgggcggcctttgatgtgcggcagctttttaagctcctcgtaggtaaggtcctcagggcattgcaggccgtgctgctccagtgcccactcctggagatgtgggttggcttgcatgaaagaagcccagagctcgcgggccataagggtctgaagctcgtcgcgaaagaggcggaactgctggcccacggccatcttttcgggggtgatgcagtaaaaggtaagggggtcccgctcccagcgatcccagcgtaaacgcacggcaagatcgcgagcaagggcgaccagcttggggtccccggagaattttatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatccctccggcgaaccgagcactcgtgctgatgcttgtaaaagcgtccgcaatactcgcagcgctgcacgggctgtaccttatccacgagatacacagcgcgtcccttaaggaaaaacttcaggagtggcggccctggctggtggttttcatgttcgcctgcgtaggacttaccctggggctcctcgaggacggagaggctgacaagcccgcgcgggagccaggtccagatctcggcgcggcgggggcggagagcgaagacaagggcgcgcagttgggagctgtccatggtgtcgcggagatccaggtccgggggcagggttctaaggttgaccttgtagaggcgggtgagggcgtgcttgagatgcaaatggtacttgatttctacgggtgagttggtggccgtgtccacgcattgcatgagcccgtagctgcgcggggccacgaccgtgccgcggtgggtttttaaaagcggtgtcgcggacgcgctcccggcggcagcggcggttccggccccatgggcaggggcggcagaggcacgtcggcgtggcgctcgggcaggtcccggtgctgtgccctgagagcgctggcgtgcgcgacgacgcggcggttgacatcctggatctgccgcctctgcgtgaagaccacgggtcccgtgactttgaacctgaaagacagttcaacagaatcaatctcggcgtcattgacggcggcctgccgcaggatctcttgcacgtcgcccgagttgtcctggtaggcgatctcggacatgaactgctcgatctcctcctcctggagatcgccgcgacccgcacgctcgacggtagcggcaaggtcattcgagatgcggtccataagctgcgaaaaggcgcccaggccgctctcgttccagacgcggctgtacaccacgtccccgtcaacgtcgcgcgcgcgcatgaccacctgcgcaaggttaagctccacgtgccgcgtaaaaacggcgtagttgcgcaggcgctgaaaaaggtagttaagggtggtggcaatgtgctcggtaacaaaaaagtacataatccagcggcgcaggggcatttcgctgatgttgccaatggcctccagcctttccatagcctcgtagaagtccacggcgaagttgaaaaactgggcgttgcgggccgataccgtaagctcgtcttccagaagccggatgagctcggcgatggtggcgcgcacctcgcgctcaaaatccccgggggcctcctcttcttcctgttccataacgacctcttcttgtatttcttctgggggcggtggtggtggcggggcccgacgacgacggcgacgcaccgggagacggtcgacgaagcgctcgatcatctccccgcggcggcgacgcatggtttcagtgacggcgcgaccctgttcgcgaggacgcagcgtgaagacgccgccggtcatctcccggtaatagggcgggtccccgttgggtagcgaaagggcgctaacaatgcatcttattaattgcggtgtaggggacgtaagcacgtcaagatcgaccggatcggaaaatttttgaaggaaagcgtctagccaatcgcagtcacaaggtaagcttaaacacgtagcagccctgtggacactgttacaattgcgattgctaatgatgtaattgaagtaggcgtttttcaggcggcggatggtggcaagaaggaccaggtccttgggtcccgcttgctgtatgcggagccgctcggccatgccccaggcctgaccctgacaccggctgaggttcttgtagtagtcatgcatgagcctctcaatgtcatcatttgcggcggaggcggagtcttccatgcgggtgaccccgacgcccctaagcggctgcacgagcgccaggtcggcgacgacacgctcggcgaggatggcctgttgcacgcgggtgagggtgtcttggaagtcgtccatgtcaacaaagcggtggtaggccccggtgttgatggtgtaggtgcagttggccataagcgaccagttaacggtttgcaaaccgggctgcacgacctcggagtacctaagccgcgagaaggcgcgcgagtcaaagacgtagtcgttgcaggtgcgcacaaggtactgatatccgactaggaagtgcggcggcggctggcggtacagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggtaggaaataatccatggtcggcacggtctggccggtaagacgtgcgcagtcattgacgctctagaggcaaaaacgaaagcggttgagcaggctcttcctccgtagcctggcggaacgcaaacgggttaggccgcgcgtgtaccccggttcgagtcccctcgaatcaggctaaagccgcgactaacgtggtattggcactcccgtctcgacccaagcccgatagccgccaggatacggtgaagagcctttttgccggccgagtggggtcgctagatttgaaagcggttaaaaaccccgctgggtagtggctcgcgcccgtagtctggacaagcatcactagggttaagttacagcagaacccggttcgcggacggccgcggcaagcgggacttagttaccccgccaatttaaagacccgcagccagccgacttttccagttacgggagcgagcccccttttttctttttgccagatgcatcccgtcctgcgccaaatgcgtcccacccccccggcgaccaccgcaaccgcggccgtagcaggcgccggcgctgtacaacagcagacagagatggacttggaagagggcgaagggctggcgagactgggggcgccgtccccggagcaacacccccgcgtgcagctgcaaaaggacgtgcgcccggcgtacgtgcctgcgcagaacctgttcagggaccgcagtggggaggagcccgaggagatgcgcgactgccggtttcgggcgggcagggagctgcgcgagggcctggaccgccagcgcgtgctgcgcgacgatgattttgagccaaacgagcagacggggatcagccccgcgcgcgcgcacgtggcggcggccaacctggtgacggcctacgagcagacggtaaaacaggagcgcaacttccaaaagagttttaacaaccacgtgcgcaccctgatcgcgcgcgaggaggtggccctgggcctgatgcacctatgggacctggcggaggccatcgtacagaacccgaacagcaagcctctgacggcgcagctgttcctggtggtgcagcacagcagggacaacgaggcgtttagggaggcgctgctaaacattgccgagcccgagggtcgctggctgctggagctaattaacattttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtaaagatagacagcttttacatgcgcatggcgctcaaggtgctaacgctgagcgacgacctgggtgtgtaccgcaacgaccgcattcacaaggccgtgagcacaagccggcggcgcgagctaagcgaccgcgagctgatgatgagcctgcgccgggcgctggtagggggcgccgccagcggcgaagagtcctactttgacatgggggcggacctgcattggcagccgagccggcgcgccttggaggccgcctacggtccagaggacttggatgaggatgaggaagaggaggaggatgcacccgctgcggggtactgacgcctccgtaatatgtttttagatgtcccagcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactgtcggccattttggaggcggtggtcccctctcggaccaaccccacgcacgagaaggtgctggcgatcgtgaacgcgctggcggagaacaaggccattcgtcccgacgaggccgggctggtgtacaacgccctgctggagcgcgtgggccgctacaacagcacaaacgtgcagtccaacctggaccggctggtgacggacgtgcgcgaggccgtggcgcagcgcgagcggttcaagaacgagggcctgggctcgctggtggcgctaaacgccttcctggcgacgcagccggcaaacgtgccgcgcgggcaggacgattacaccaattttatcagcgcactgcggctgatggtgaccgaggtgccccagagcgaggtgtaccagtcgggcccggactactttttccagactagcagacagggcctgcagacggtaaacctgagccaggctttcaagaacctgcgcgggctgtggggcgtgcaggcgcccgtgggcgaccggtcgacggtgagcagcttgctgacgcccaactcgcggctgctgctgctgctgatcgcacccttcaccgacagcggcagcgtaaaccgcaactcgtacctgggccacctgctgacgctgtaccgcgaggccataggccaggcgcaggtggacgagcaaaccttccaggagatcacgagcgtaagccgcgcactggggcagaacgacaccgacagtctaagggccacccttaacttcttgctgaccaatagacagcagaagatcccggcgcaatatgcgctgtcggccgaggaagaaaggattctgagatatgtgcagcagagcgtagggctgttcctgatgcaggagggggccacccccagcgccgcgctggacatgaccgcgcgcaacatggaacctagcatgtacgccgccaaccggccgtttattaataagctgatggactacctgcaccgcgcggcgtccatgaactcggactactttaccaatgccatcttgaacccgcattggctcccgccgccagggttctacacgggcgagtacgacatgcccgaccccaacgatgggtttttgtgggacgacgtggacagcgcggtgttctccccaattttgcaaaagcgccaggaggcggtgcgcacgcccgcgagcgagggcgcggtgggtcggagcccctttcctagcttgggcagcttgcatagcctgcctgactcagtaaacagcggcagggtgagtcggccgcatttgctgggcgaggacgagtacctgaacgactcgctgctgcggccgccgcgggccaagaacgccatggccaataacgggatagaaagtctggtggacaaactgaaccgctggaagacctacgctcaggaccatagggaacctgcgcccgcgccgcggcgacagcgccacgaccggcagcggggcctggtgtgggacgacgaggactcggccgacgatagcagcgtgttggacttgggcgggagcggtagggttaacccgttcgcgcatctgcagcccagactggggcgacggatgttttaaatgcaaaataaaactcaccaaggccatagcgtgcgttctcttccttgttagaaatgaggcgcgcggtggtgtcctctcctcctccctcgtacgaaagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctcaactaccaaaacgaccacagcaacttcctaaccacggtggtgcagaacaacgatttcacccccgccgaggccagcacgcagacgataaattttgacgagcggtcccggtggggcggtgatctgaagaccattttgcacaccaacatgcccaatgtgaacgagtacatgttcaccagcaagtttaaggcgcgggtgatggtggctaggaagcacccacagggggtagctgaaacagatttaagtcaggataagcttgaatatgagtggtttgagtttaccctgcccgagggcaatttttccgagaccatgaccatagacctgatgaacaacgccatcttggaaaactacttgcaagtggggcggcaaaatggcgtgctggagagcgatattggagttaagtttgacagcagaaatttcaagctgggctgggacccggtgactaagctggtgatgccgggggtctacacatacgaggccttccatcccgacgtggtgctgctgccgggctgcggggtggacttcaccgagagccgcctgagcaaccttctgggcattcgcaagaagcaacctttccaagagggcttcaggattatgtatgaggatctagaagggggcaacatccccgccctgctggatgtggaagcatacctcaaaagcaagaatgatcgggaggaagccacccagaatgcaaacagagttgctgcaaatggaggtggtgaaattaggggagatacttttcttaccaccgaacagctaagagccgctgacaaggagctggttattaagcccattaaggaagatgctagcaagagaagctataatgtcataggggacacccatgacaccctgtaccgcagctggtacctgtcctatacctacggggaccccgagaagggggtacagtcgtggacgctgctcaccaccccggacgtcacctgcggcgcggagcaagtctactggtcgctgccggacctcatgcaagaccccgtcaccttccgctccacccagcaagtcagcaactaccccgtggttggcgccgagctcatgcccttccgcgccaagagcttttacaacgatctcgccgtctactcccagctcatccgcagctacacctccctcacccacgtcttcaaccgcttccccgacaaccagatcctgtgtcgcccgcccgcgcccaccatcaccaccgttagtgaaaacgtgcctgctctcacagatcacgggacgctaccgctgcgcagcagtatccgcggagtccagcgagtgaccgttactgacgcccgtcgccgcacctgtccctacgtctacaaggccctgggcatagtcgcgccgcgcgtgctctctagtcgcaccttttaaaaaatgtccattcttatctcgcccagcaataacaccggctggggtcttactaggcccagcaccatgtacggaggagccaagaagcgctccgatcagcaccccgttcgcgtccgcggccactttcgcgctccctggggcgcttacaagcgcgggcggacctctgcccccgccgccgtgcgcaccaccgtcgacgatgtcattgactcggtagtcgctgacgcgcgcaactacacccccgccccctccaccgtggacgcggtcattgacagcgtggtggctgacgcgcgcgactatgccagacgcaagagccggcggcgacgcattgccaggcgccaccggagcacgcccgccatgcgcgccgcccgggctctgctgcgccgtgccagacgcactggccgccgggccatgttgcaagccgcgcgtcgcgccgccgccgcacccacccccacaggcaggactcgcagacgagcggccgttgccgccgccgcggccatctctagcatgaccagacccaggcgcggaaacgtgtactgggtgcgcgactccatcacgggcgtgcgcgtgcccgtgcgcacccgtcctcctcgtccctgatctaatgcttgtgtcctcccccgcaagcgacaatgtcaaagcgcaaaatcaaggaggagatgctccaggtcgtcgccccggagatttacggaccaccccaggcggaccagaaaccccgcaaaatcaagcgggttaaaaaaaaggatgaggtggacaaggaggcagtagagtttgtgcgcgagtttgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtatggcgacgacgacatcctggaccaggcggcggagcgggcgggcgagttcgcctacgggaagcggtcgcgcgaagaggagctgatctcgctgccgctggacgagagcaaccccacgccgagcctgaagcccgtgaccctgcagcagatgctgccccaagcagtgctgctgccgagccgcggggttaagcgcgagggcgagaacatgtacccgaccatgcagatcatggtgcccaagcgtcggcgcgtggaggacgtgctggacaccgtgaaaatggatgtggagccccaggtcaaggtgcgccccatcaagcaggtggcgccgggcctgggcgtgcagaccgtggacattcaaatccccaccgacatggatgtcgacaaaaaaccctcgaccagcatcgaggtgcagaccgacccctggctcctagcctccaccgccgccacggccaccgagcctcccaggaggcgaagatggggccctgccaaccggttgatgcccaactacgtgttgcatccttccatcattccgacgccgggctaccgcggcacccggtattacgccagccgcaggcgccccgcaggcaagcgccgtcgccgcaccaccacccgccgccgtctggcccccgcccgcgtgcgccgcgtaactacgcgccggggccgctcgcttgttctgcccaccgtgcgctaccaccccagcatcctttaattcgtgtgctgtgatactgttgcagagagatggctctcacttgccgcctgcgcattcccgtcccgaattaccgaggaagatcccgccgcaggagaggcatggcaggcagcggcctaaaccgccgccggcggcgggccatgcgcaggcgcctaagtggcgggttcctgcctgcgcttatccccataatcgccgcggccattggcacgatcccgggcatagcttccgttgcgctgcaagcgtcgcagcgccgttaatgtgcaaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcaacgctccggacctatgggaacaaggcctggaatagtagcacagggcagatgttgagggaaaagcttgcagaccaaaacttccagcaaaaggtggtggacggcctggcctcgggcattaacggggtagtggacattgcaaaccaggccgtgcagcgcgagataaacagccgcctgaacccgcggccgcccacggtagtggagatggaagatgcaactcttccccccaggggcgagaagcggccgcggcctgacgcggaggagacaaccctgcaggtagacgagccgccctcgtacgaggaggccctcaaggccggcatgcccaccacacgcatcattgcgccaatggccacgggtgtcatgaaacccgccacccttgacctgccttcaccacccgtgcccgctccaccaaaggcagctccggttgagcaggcccccccggtggcaaccgccgtgcgccgcgttcccgcccgccgccaggcccagaactggcagagcacgctacacagtatcgtgggcctaggagtgaaaagtctgaagcgccgccgatgctattaagaaaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgtgccaccgacacgtacttcagcctgggcaacaagtttagaaaccccacggtggctcccacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacgtactttgacatccgcggcgtcctggaccgcggtcccagcttcaaaccctactcgggcacggcttacaacagcctggctcccaagggcgcccccaatcccagtcagtgggaacaggcaaaaacaggagctggtgtagaccaaaatcaaaaagaaactcgcacttacggcgtagccgccactggcggatataacattacaaaagaaggacttcagattggaattgatgaaactaaagaagatccaaacaacaaaatttatgcagataaaacattccagccggaaccacaaataggggaaaataattggcaggacactaatgttttctatggcggcagagctcttaaaaaggaaaccaagatgaaaccatgctatggctcatttgccagaccaactaataaaaaaggagggcaggctaaagttttaaccactgaagatggtcaacctacagaaaactttgacatagacttggctttctttgatattccacaagctggtggaaatgacaatcttgatccagatatgattctgtatgccgaaaatgtaaatctagaaacacctgacacacatgtagtttataaaccaggcaaggatgatgcaagttctgccgctaacctcacacaacagtccatgccaaacagacccaactacatcggtttcagggacaactttgtgggacttatgtattacaacagcactggcaacatgggtgtgctggctggtcaggcctctcagttaaatgctgtggtcgacttgcaagacagaaataccgagctgtcttatcagcttttattagattctctgggtgacaggaccagatactttagtatgtggaactctgcggtggacagctatgatccagatgtcaggatcattgagaatcacggtgtggaggacgaacttccaaattattgcttcccattggatggtaccggtaccaatgccacataccaaggtgtggaaccagataatgctcaaggtcaaaatgataaatggaaaaaggacgagaaagtggctgctcaaaaccaaatttgcaagggcaatatttatgccatggagattaacctccaggccaacctgtggaagagttttctgtactcgaacgtggccttgtacctgcccgactccttcaagtacacgccggccaacgtcacgctgcccactaacaccaacacctacgagtacatgaacgggcgcgtggcggccccctcgctggtggacgcctacgtcaacattggcgcccgctggtcactggaccccatggacaacgttaacccctttaaccaccaccgcaatgcgggcctgcgctaccgctccatgctgctgggcaacgggcgctacgtgcccttccatattcaagtgccccaaaagttttttgccattaagaacctgcttctgctcccgggctcctacacctacgagtggaacttccgcaaggatgttaacatgattctgcagagttcccttggcaacgacctgcgcgtcgacggtgcctccgtccgcttcgacagtgttaacctttacgccacctttttccccatggcgcacaacaccgcctccaccctggaagccatgctgcgcaacgacaccaacgaccagtccttcaacgactacctctcagccgccaacatgctttaccccatcccagccaaggccaccaacgtgcccatttccatcccctcgcgcaactgggccgcctttcgcggctggagtttcacccgcctaaaaaccaaggaaactccctccctcggctcgggttttgacccctactttgtttactcgggcaccatcccctacctcgacgggaccttctacctgaaccacacctttaagaaggtctccatcatgttcgactcctcggttagctggcccggcaacgacaggctgcttacgccgaacgagtttgaaattaagcgcagcgtcgacggggagggctataacgtggcccaatgcaacatgaccaaggactggttcctggtccagatgctttcccactacaacattggctaccagggcttccatgtgcctgagggctacaaggaccgcatgtactccttctttcgcaacttccagcccatgagtaggcaggtggttgatgagattaactacaaggattacaaggccgttgccctgcccttccagcacaacaactcgggcttcaccggctacctcgcacctaccttgcgccagggacagccgtaccccgccaacttcccctacccgcttatcggacagaccgccgtgccctccgttacccagaaaaagtttctctgcgacagggtcatgtggcgcatccccttctccagcaacttcatgtctatgggcgcccttaccgacctgggtcaaaacatgctttacgccaactcggcgcacgcgctcgacatgacctttgaggtggaccccatggatgagcccaccctcctgtatcttctctttgaagttttcgacgtggtcagagtgcaccagccgcaccgcggcgtcatcgaggccgtctacctgcgcacgcccttctccgccggcaacgccaccacctaagcatgagcggctccagcgaacaagagcttgcggccatcgtgcgcgacctgggctgcgggccctactttttgggcacccacgacaagcgcttcccgggcttccttgccggcaacaagctggcatgcgccatcgtcaacacggccggccgcgaaaccgggggcgtgcactggcttgcctttggctggaacccgcgctcgcgcacctgctacatgtttgacccctttgggttctcggaccgccggcttaagcagatttacagcttcgagtacgaggccatgttgcgtcgcagtgccctggccttatcgcccgaccgctgtcttagcctcgagcagtccacccagaccgtgcaggggcccgactccgccgcctgcggactcttttgttgcatgttcttgcatgcctttgtgcactggcccgatcgacccatggacgggaaccccaccatgaacttgctgacgggggtgcccaatggcatgctacaatcgccacaggtactgcccaccctccggcgcaaccaggagaagctctaccgcttccttgcgcaccactccccctactttcgctcccaccgcgccgccatcgaacacgccaccgcttttgataaaatgaaacaactgcgtgtataactcaaataaacagcacttttattttacatgcactggagtatatgcaagttatttaaaagtcaaaggggttctcgcgctcgtcgttgtgcgccgcgctgggaagggccacgttgcggtactggtacttgggctgccacttaaactcggggatcaccagtttaggaacagcaatctcggggaaggtctcgctccacatgcgccggctcatttgcagggcgcccagcatgtccggggcggagatcttaaaatcgcagttgggaccggtgctttgcgcgcgcgagttgcggtacacagggttgcagcactggaacaccatcagactggggtactttacgctggccagcacgctcttatcgctaatttgatccttgtccaggtcctcggcgttgctcaggccgaacggggtcatcttacacagctggcggcccaggaagggcacgctgtggggcttgtggttacactcgcagtgcacgggcattagcatcattcccgcaccgcgctgcatattcgggtatagggccttaacaaaggccataatctgcttaaaagcttgctgggccttagctccctcgctaaaaaacaggccgcagcttttcccgctaaactggttatttccgcacccggcatcttgcacgcagcagcgcgcgtcatggctggtcagttgcaccacgcttctcccccagcggttctgggtcactttggccttgctgggttgctccttcaacgcgcgctgaccgttctcgctggtcacatccatctccaccacatggtccttgtggatcattaccgtcccgtgcagacacttaagctggccttccacctcggcacagccgtggtcccacagggcactgccggtgcactcccagtttttgtgcgcgatcccgctgtggctaaagatgtaaccttgcaacaggcgacccatcacggtgctaaagctcttctgggtggtaaaggtcagttgcatcccgcgggcctcctcgttcatccaggtctggcacattttttggaatatctcggtctgctccggcataagcttgtaagcattgcgcaggccgctgtcgacgcggtagcgttccatgagcacgtttatggtatccatgcccttctcccaggacgaaaccaaaggcagactcagggggttgcgcacgttcaaaataccaggggtcgcgggctcgacaatgcgttttccgtccttgccttccttcaacagaaccggcggctggctgaatcccactcccacgatcacggcatcttcctggggcatctcttcgtcggggtttaccttggtcacatgtttggtctttctgggctgcttcttttttggagggctgtccactggaaccacgtcctcctcggaagacccggagcccacccgctgatactttcggcgcttggtgggcagaggaggtagcggcggcgaggggctcctttcctgctccggcggatagcgcgccgacccgtggccccggggcggagtggcctctcggtccataaaccggcgcacgtcctgactgccgccggccattgtttcctaggggaagatggaggagcagccgcgtaagcaggagcaggaggaggagaacttaaccacccacgagcaacccaaaattgagcaggacctgggcttggaagagccggctcgtctagaacccccacacgatgaacaggagaagaccaacgctgggctggagcatggctacctaggaggacaggaggatgtgctgctaaaacacttgcagcgccagtcctttatcctccgggacgctctggccgaccgaagcaaaacccccctcagcgtccaggagctgtgtcgggcctacgagctcaacctcttctcgccgcgcgtgccccccaaacgccagcccaacggcacctgcgagcccaacccgcgtcttaacttctaccccgtctttgcggtccccgaggcccttgccacttatcacatattttttaaaaaccaaaaaatccccgtttcctgccgcgccaaccgcacccgcgccgacgcactcctcgctctggggcccggcgcgcgcatacctgatatcgcttccctggaagaggtgcccaagatctttgaagggcttggtcgggacgagacgcgcgcggcgaacgctctaaaagaaacagcagaggaaaagggttacactagcgccctggtagagttggaaggcgataacgccaggctggccgtgcttaagcgcagcgtcgagcttacccatttcgcctaccctgccgttaacctcccgcccaaggtcatgcgtcgcatcatggatcagcttatcacgccccacattgaggcccttgatgaaagccaaaagcagcgccctgaggacgcccggcccgtggtcagcgacgaaatgcttgcgcgctggctcggaaaccgcgacccccagtccctggagcagcggcgtaagctcatgctggccgtggtcctggtcaccctcgagttggaatgcatgcgccgcttttttagcgaccccgaaaccctgcgcaaggttgaagagaccctgcactacactttcaggcacggctttgtcaggcaggcctgcaagatctctaacgtggagctaaccaacctggtctcctgcctgggtattttacacgagaaccgcctggggcagaccgtgcttcactcgaccctgaagggcgaggcgcggcgggactacatccgcgactgtgtctttctttttctttgccatacctggcagtcggccatgggcgtgtggcagcagtgtctccaggacgagaacctgaaggagctggacaagcttcttgctaaaaaccttaaaaagttatggacgggctttgacgagcgcaccgtcgcctcggacctggccgagattgtttttcctgaacgcctgaggcagacgcttaaaggcgggctgcccgactttatgagccagagcatgttgcaaaactaccgcactttcattctcgagcgatcgggaatcctgcccgccacctgcaacgccttcccctccgactttgtcccgctgagctaccgccagtgtcccccgccgctgtggagccactgctacctcttgcagctggccaactacatcgcccaccactcggacgtgatcgaggacgtaagcggcgaggggctgcttgagtgccactgccgctgcaacctgtgctccccgcaccgctccctggtctgcaacccccagctcctaagcgagacccaggtcatcggtacctttgagctgcaaggtccggaaaactccaccactccgctgaaacttacgccggggttgtggacttccgcgtacctgcgcaaatttgtaccccaggactaccacgcccacgagataaagttctttgaggaccaattgtgcccacagcacgcggatcttacggcctgcgtcatcacccagggcgcaatcctcgcccaattgcacgccatccaaaaatcccgccaagagtttcttctaaaaaagggtaaaggggtttacctggacccccagacaggcgaagtgcttaacccgggtcttccccagcatgccgaggaagaagcaggagccactagtggaggagatggaagaagaatgggacagccaggcagaggaggacgaatgggaggaggaggaggaagaattggaagaggtgcaacaggagcaggcaacagagcagcccgtcgccgcaccatccgcgccggcagcccctccggtcaagcctcctcgtagatgggatcaagtgaagggtgacggtaagcaccagcggcagggctaccgatcatggagggcccacaaagccgcgatcattgcctgcttgcaagactgcggggggaacattgcttttgcccgccgctacctgcttttccaccgcggggtaaacatcccccgcaacgtgttgcattactaccgtcaccttcacagctaacaaaaagcaagtaagaggagtcgccggaagaggaggcctcaggattgcggcggacgagcccttcaccaccagggagctaagaaaccgaatattccccactctttatgccatttttcagcagagtcgaggtcagcagcaagagcttaaagtaaaaaatcggtctctgcgctcgctcacccgcagttgcttgtaccacaaaaacgaagatcagctgcagcgcactcttgaagacgccgaggctttgtttcacaagtactgcgcgctcactcttaaagactaaggcgcgcccacccgaaaaaaaggcgggaattacctcatcgccagcaccatgagcaaggagattcccacgccttacatgtggagctatcagccccagatgggcctagccgcgggcgcctcccaggactactccacccgcatgaactggctcagtgccgggccctcaatgatctcacaggtcaacgggatccgtaaccatcgaaaccagatattgttggagcaggcggcagtcacctccacgcccagggcaaagcttaacccgcgtaattggccctccaccctggtgtaccaggaaattcccgggccaactaccgtactacttccgcgtgacgcactggccgaagtccgcatgactaactcaggtgtccagctggccggcggcgcttcccggtgcccgctccgcccacaatcgggtataaaaaccctggtgatccgaggcaaaggcacacagcttaacgacgagttggtaagctctgcaatcggtctgcgacctgatggagtgtttcaactagccggagccgggaaatcgtcctttactcccaaccaggcctacctgaccttgcagagcagctcttcggagcctcgctccggaggcattggaaccctccagtttgtgcaggagtttgtgccctcggtctactttaaccccttctcgggatcgccaggcctttacccggacgagtttataccgaactttgacgcagtgagagaagcggtggacggctacgactaaatgtcctatggtgactcggctgagcttgctcggttaaggcatctggaccactgccgccgcctgcactgctttgcccgggagagctgcgggcttatctactttgagcttcccaaggagcaccccaacggccctgcacacggagtgcggattaccgtagagggcaccaccgagtctcacctggttaggttcttcacccagcaacccttcctggtcgagcgggaccgggctgcaaccacctacaccgtgtactgcatttgtccaaccccgaagttgcatgaaaatttttgctgtactctttgtggtgagtttaataaaagctgaaataagactctactctggaatccagtgtcgtcataatcgcaccgagaccattaactttaccacccaggaacaggtgaactttacctgcaaactccacaagaagtacctcatatggtttttcaacaacactactcttgcagtagttaacacctgtgacaacgacggtgttcttcttcccaacaatctcaccagtggactagccttctctgttaaaagggcaaagctaattcttcattgccctataactgatttaagcccaaaaaccaatcaaacccccttttcccatctacccaaataaacatttattggaaataattattcaataaagatcacttacttaaaatctgaaagtatgtctttggtgtagttgtttagcagcacctcagtcccctcctcccagctctggtactccagtccccggcgggcggcaaactttctccacaccttgaaagggatgtcaaattcctggtccacaattttcattgtcttccctcttagatgacaaagagactccgggtggaagatgacttcaaccccgtctacccctatggctacgcgcggaatcaaaatattcccttcctcactcccccctttgtctcctccaatggatttcaaaacttcccccctggggtcctgtcacttaaactggctgacccaatcaccattaacaatcaaaatgtatcactcaaggttggaggggggctaactttgcaagaagaaactggaaaattaacagttaatactgaaccacctttgcatcttacaaataacaaattagggatagctttagacgctccatttgatgttatagacaataagcttacactattagcaggccatggcttgtctattataacaaaagaaacatcaacactgcctggcttggttaatactcttgtagtattaactggaaagggtattggaacagatttatcaaataatggtggaaatatatgtgttagagttggagaaggcggcggcttatcatttaatgacaatggagacttggtagcatttaataaaaaagaagacaaacgcaccctatggacaactccagacacatctccaaattgcagaattgatcaggataaggactctaagctaactttggtccttacaaagtgtggaagtcaaatattagccaatgtgtcattaattgttgtagctggaaggtacaaaattatcaataacaatactaatccagctcttaaaggatttaccattaaattgttgtttgataaaaatggagtccttatggaatcttcaaatcttggtaaatcatattggaactttcgaaatcaaaattcaattatgtcaacagcttatgaaaaagctattggttttatgcctaatttggtagcctatccaaaacctaccactggctctaaaaaatatgcaagagatatagtttatggaaacatctaccttggcggaaagccacatcaaccagtaaccattaaaactacctttaaccaggaaactggatgtgaatactctattacatttgattttagttgggccaaaacttatgtaaatgttgaatttgaaactacctcttttaccttttcctatattgcccaagaataaaggataaataaacgtgtttttcatttaaaaatttcatgtatctttattgatttttacaccagcgcgggtacacattctcccaccaccagcccattttacagtgtaaacaattctctcagcacgggtggccttaaataggggaaagttctcattagtgcgggaactggacttggggtttataatccacacagtttcctggcgagccaaacgggggtcggtgattgagatgaagccgtcctttgaaaaatcatccaagtgggcctcgcagtccaaggtcacagtctggtggaatgagaagaacgcacagactcatactcggaaaacaaaatgggtctgtgcctctccatcagcgcccttaacagtctctgccgccggggctcggtgcggctgctacagatgggatcgggatcgcaagtctctttcactataatccccacagcctttagcattagtcttctggtgcgtcgggcacagcaccgcatcctaatctcgctcatgttttcacagtaagtgcagcacataatgaccatgttattcagcagcccataatttagggtgctccagccaaagcttatgttggaaatgatggaacccacgtgaccatcgtaccaaatgcggcagtatatcaggtgcctgccccttataaacacactgcccatatacataatctctttggacatgtttctatttacaatctgccggtaccaggggaagcgctggttgaacatgcacccgtaaatgactctcctaaaccacacggccagcagggtgcctcccgcccggcactgcagggagcccggggataaacagtggcaatgcaggatccagcgctcgtacccgcttaccatctgggctcttaccagatccagggtagcgggacacaggcacactgacatacatctttttaaaatttttatttcctttcgggtcaggatcatatcccaggggactggaaactcttggagcagggtaaaaccagcagcacatggtaatccacggacagaacttacattatgataatctgcatgatcacaatcgggcaatacagggtgttgttcagtcaaagaggccctggtctccttatcatatcgtggtaaacgggccctgcgatatggataatggcggagcaaggttgattgttccttggtgctcattgtagcgcaccctcttgcgtacctcgttgtacttttgccagcagaaagtggccctggaacagcaaatacctctcctccgaccgtcctttcgctgttgccgctcagtcatccaactgaagtacatccattcccaaaggttgtgaagaagttcctttgtatctaatgaaacaaaaagcccgtccatgcggattcccctcatcacatcagccaggactctgtaggccatccccatccagttaatgctgccttgtctatcatttaaagggggcggtggcaaaattggaagaaccatttttattccaaacggtctcgaaggacgataaagtgcaagtcacgcaggtgacagcgttcaccgccgctgtgttggtggaaacatacagccaggtcaaaacccactctattttcaaggtgctcgactgtggcttcgagcagtggctctacgcgtacatccagcataagaatcacattaaaagccggccctccatcgatttcatcaatcatcatgttacattcctgcaccatccccaggtaattctcatttttccagccttggattatttctacaaattgttggtgtaagtccactccgcacatgtggaaaagctcccatagcgccccctccactttcataatcaggcagaccttcataatagaaacaaatcctgctgctccaccacctgcagcgtgtttaaaacaacaacatttaataaggttctgccctcagcccttagctgacgtctaagtgtcagctgcaaaaagtcacttaagtcctgggccactacagctgacaattcagagccagggctaagcgtgggactggcaagcgtaagggagtactttaatgctccaaagctagcacctaaaaactgcatgctggaataagctctttttgtatctccggtaatgccttccaaaatgtgagtaataaagcgaggtagtttttctttaatcatgttagtaatagaaaaatcctctaaatacgtcactaggaccccagggaccacaatgtggtagcttacaccgcgtcgctgaagcatggttagtagagatgaaagtctgaaaaacaaaaagcatgcgctaaaccaaggtggctatttttactgaaggaaaaattactttttttagcagcagggtgcccactgggtggcccttgcggacatacaaaaattggtccgtgtgattaaaaagcagtacagcaagctcctgtcttctcccggcaaaaatcacatcggactgggttagtatgcccctggcatggtagtcatttaaagccataaatgtgccctgataaccagtaggaacgagtacactgacttttaggtaaaccaataccaccccatgcggaaaaatataaaaagattcaggacaaaaaaaggtatatttattgctagccccttcctggacgggagccatccctccagggctatctataaaagcatagagacattcagccatagcttagcccgcttaccagtagacaaagagcacagcagtacaagcgccaacagcaataactacttactgtgccagctcagtacttaaaggcagcttacactgacgtaatgaccaaaggtgtaaaaaccccgccaaaaaaaaacacacacgccctaggtgtttttcgtaaaaacacttccgcgttctcacttcctcgtatcaattttgtgacttaacttccgggttcccacgttacgtcacttttgcccttacatgtgactgtgccatagggcgccattttcccgtgcccaatatggctaaagtccgcttttttatacgtcatcggccccgcgacttgcttccgggttgggccacgcctttgcggcaaccgccggccgtacgtcttgacgtcaactgcattaccgcttgttaaccacttaacgttggccctgccctaaaaccgttaaaatttaaaagctcatttgcatattaacttttgtttactttgtggggtggatttataggtgggccagtgaattgtaatacgactcactatagggcgaattgggccctctagatgcatgctcgagcggccgccagtgtgatggatatctgcagaattcgcccttccttaattaacctgcag

SEQ ID NO: 19 - DNA, 35325 bp, Adenovirus D9
  MISC_FEATURE (1)..(35325): Complete Genome
ctgcaggttaattaaggaagggcgaattctgcagatatccatcacactggcggccgctcgagcatgcatctagagggcccaattcgccctatagtgagtcgtattacaattcactggccccatctatataatataccccacaaagtaaacaaaagttaatatgcaaatgagcttttgaattttaacggtttcggggcggagccaacgctgattggacgagagaagacgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgatccgcagggtatttaaaccagtcgagtccgtcaagaggccactcttgagtgccagcgagtagagatttctctgagctccgctcccagagaccgagaaaaatgagacacctgcgcctcctgccttcaactgtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaggaggctgtgaatttaatatttccagaatctatgattcttcaggctgacatagccaacgaatctactccacttcatacaccgactctgtcacccatacctgaattggaagaggaggacgaactagacctccggtgttatgaggaaggttttcctcccagcgattcagaggatgaacggggtgagcagaccatggctctgatctcagactatgcttgtgtgattgtggaggagcaagatgtgattgaaaaatctactgagccagtacaaggctgtaggaactgccagtaccaccgggataagtccggagatgtgaacgcctcctgcgctttgtgctatatgaaacagactttcagctttatttacagtaagtggagtgaatgtgagagaggctgagtgcttaacacataactgtaatgcttgaacagctgtgctaagtgtggtttattttgttactaggtccggtgtcagaggatgagttatcaccctcagaagaagaccacccgtctccccctgagctgtcaggcgaaacgcccctgcaagtgttcagacccaccccagtcagacccagtggcgagaggcgagcggctgttgacaaaattgaggacttgttgcaggacatgggtggggatgaacctttggacctgagcttgaaacgccccaggaactagacgcagctgcgcttagtcatgtgtaaataaagttgtacaataaaagtctatgtgacgcatgcaaggtgtggtttatgactcatgggcggggcttagtcctatataagtggcaacacctgggcacttgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataaagaggaatttgaaaatatttttgctgactgctctggcctgctagattctctgaatcttggccaccagtcccttttccaggaaagggtactccacagccttgatttttccagcccagggcgcactacagccggggttgcttttgtggtttttctggttgacaaatggagccaggacacccaactgagcaggggctacatcctggacttcgcagccatgcacctgtggagggcctggatcaggcagcggggacagagaatcttgaattactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagttaagagggagaggagcgatgggggtaataccgggatgatgaccgagctgacggccagcctgatgaatcggaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttcttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacctgcgattcgggggtctgccatatcctgaagaacatccatgtgacctcccaccccagaaagaagtggccagtgtttgagaataacctgctgatcaagtgccatatgcacctgggagccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtcgagtgagtagtgggcgtggctaaggtgactataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggagctcgtcgctcgacagcaccgccgcagccgcggcagccgcagctgccatgacagcgacgagactggcctcgagctacatgcccagcagcggcagcagcccctctgtgcccagttccatcatcgccgaggagaaactgctggccctgctggccgagctggaagccctgagccgccagctggccgccctgacccagcaggtgtccgagctccgcgagcagcaacagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtctttgagaaggagactgatggccacggggagccccttggtgtaggtattggcgaagcggttgagctgggagggatgcatgcggggggagatgatgtgcagtttggcctggatcttgaggttggcgatgttgccacccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcattcatccatgatgatggcgatgggcccgtgggctgcggctttggcaaagacgtttctggggtcagatacatcataattatgctcctgggtgagatcatcataagacattttaatgaatttggggcggagggtgccagattgggggacgatggttccctcgggccccggggcgaagttcccctcacagatctgcatctcccaggctttcatctcggagggggggatcatgtccacctgcggggcgatgaaaaaaacggtttccggggctggggtgatgagctgcgaagagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccgaacgagctcgccgaggaggcggtccccgcccagcgagaggagctcttgcagggaagcaaagtttttcaggggcttgagtccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgggcccctggctgggcgcttgcaagggtgcgcttgagactcatcctgctggtgctgaaacgggcacggtcttcgccctgcgagtcggcgagatagcagttgaccatgagctcgtagttgagggcctcggcggcgtggcccttggcgcggagcttgcccttggaagagcgcccgcaggcgggacagaggagggattgcagggcgtagagcttgggggcgagaaagacggactcgggagcgaaagcgtccgctccgcagtgggcgcagacggtctcgcactcgacgagccaggtgagctctggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccactagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcgatgctttttaggagactttcatccatctggtcagaaaagactatttttttattgtcaagcttggtggcgaaggagccatagagggcgttggatagaagcttggcgatggatctcatggtctgatttttgtcacggtcggcgcgctccttggccgcgatgtttagctggacatactcgcgcgcgacgcacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcatccaaggccatctgccactcgcgggcggccagcgctcgctcgtaggggttgaggggcggaccccagggcatgggatgagtgagggcggaggcgtacatgccgcagatgtcgtagacatagatgggctccgagaggatgccgatgtaggtgggataacagcgccccccgcggatgctggcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttcgcggatgatgtcataacccgcctctcctttcttctcccacagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgctcgcggcatgaaattgcgggtgatgcggaaagggcccgggacggaggctcggttgttgatcacctgggcggcaaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctctagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcgggttcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggctttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggtcgtgtccacgcattgcatgagcccgtagctgcgcggggccacgaccgtgccgcggtgcgcttttagaagcggtgtcgcgggcgtgctcccggcggcagcggcggttctggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggtcatgaactgttcgatctcctcctcctggagatcgccgcggcccgcgcgctccacggtggcggcgaggtcattggagatgcggcccatgagctgcgagaaggcgcccaggccgctctcgttccagacgcggctgtagaccacgtccccgtcggcgtcgcgtgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcattgcgggccgagaccgtgagctcgtcttccaggagccggatgagctcggcgatggtggcgcgcacctcgcgctcgaaatccccgggggcctcctcttcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacaaagcggtggtaggccccggtgttgatggtgtaggtgcagttggccatgagcgaccagttgacggtctgcaggccgggttgcacgacctcggagtacctgagccgcgagaaggcgcgcgagtcgaagacgtagtcattgcaggtgcgcacgaggtactggtagccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtccccttgaatcaggctggagccgcgactaacgtggtattggcactcccgtctcgacccgagcccgatagccgccaggatacggcggagagtcctttttgccggccaaggggggtcgctagacttgaaagcgaccgaaaaccctgccgggtagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgctcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcactgctgaacatcgccgagcccgagggtcgctggctgctggagctgatcaacatcttgcagagcatcgtagtgcaggagcgcagcctgagcttggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctaagcgaccgcgagctgatgctgagcctgcgccgggcgctggtagggggcgctgccggcggcgaggagtcctacttcgacatgggggcggacctgcattggcagccgagccggcgcgccttggaggccgcctacggtccagaggacttggatgaggaagaggaagaggaggaggatgcacccgctgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggttccccagagcgaggtgtaccagtcgggcccggactactttttccagacgagccggcagggcttgcagacggtgaacctgagccaggctttcaagaacctgcgagggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaacttcttgctgaccaatagacagcagaagatcccggcgcaatatgcgctgtcggccgaggaggaaaggatcctgagatatgtgcagcagagcgtagggctgttcctgatgcaggagggggccacccccagcgccgcgctggacatgaccgcgcgcaacatggaacctagcatgtacgccgccaaccggccgttcatcaataagctgatggactacctgcaccgcgcggcggtcatgaacacggactactttacaaacgccatcctgaacccgcactggctcccgccgccggggttctacacgggcgagtacgacatgcccgaccccaacgacgggttcctgtgggacgacgtggacagcgtggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgttggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtggctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcaaaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggctacagccgatacaaccactaggggtgatacatttggaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgtcacctgcggcgcggagcaagtctactggtcgctgccggacctcatgcaagacccagtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcagtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccactgctaccgtctccacttctaccgccgccacggctaccgagcctcccaggaggcgaagatggggcgccgccagccggctgatgcccaactacgtggtgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaattcgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgctaagggaaaagctcaaagaccagaactttcagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaaaggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcagctcccgcggtcgtgcaggcccccccggtggcgaccgccgtgcgccgcgtccccgcccgccgccaggcccagaactggcagagcacgttgcacagtatcgtaggcctgggagtgaaaagtctgaagcgccgccgatgctattgaaagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagtctggcccccaagggtgcccccaactccagccagtggcttgcaaaagacaccaatgctggcgatcaagcattaaaaacccacacacatggcgtagctgctatggggggaacagatatcacagcaaagggtttgcaaattggtgttgacacgactgaaaacaagaatgagcctatttatgcaaatgaaatataccagccagaacctcaggtaggagaggaaaacttgcaagatgttgaaaacttttatggaggcagagctcttaaaaaagaaaccaaaatgaaaccttgctatggctcgtttgccagacccacaaatgaaaaaggcggtcaagccaaatttttaactgacggcgatggtcagctaactaaaaatcatgatatcacaatgaatttctttgacactcctggaggaacagttggtcaggatactgaacttgaagcagacattgttatgtatgctgagaatgtgcatctggaaactccagacacgcatgtggtgtacaaaccaggaacttctgatgagagttcagaagcaaatttggttcagcagtccatgccaaacaggcccaactacatcggcttcagggacaactttgtgggtctcatgtactataacagcactggcaacatgggtgtgctggctggtcaagcatctcagttgaatgctgtggtcgacttgcaagacagaaacacagagctgtcttaccagctcttgctagattctctgggtgacagaaccagatactttagcatgtggaactctgcagtggacagttatgatcctgatgtcaggattattgaaaatcacggtgtggaagatgaacttccaaactattgcttcccattggatggagctggcactaatgctacctaccaaggtgtaaaagttaaaaatggccaagatggagatgtaaacgcagattgggaaaaagatccaaatcttgcttcacgaaaccaaatatgcaagggtaacatcttcgccatggagatcaacctccaggccaacctgtggaagagttttctgtactcgaatgtggccctgtacctgcccgactcatacaagtacacgccggccaacgtcacgctgcccgccaataccaacacctacgagtacatgaacggccgcgtggtagccccctcgctggtggacgcctacatcaacatcggcgcccggtggtcgctggaccccatggacaacgtcaacccattcaaccaccaccgcaacgcgggcctgcgttaccgctccatgcttctgggcaacggccgctacgtgcccttccacatccaagtgccccaaaagttctttgccatcaagaacctgctcctgctccccggctcctacacctacgagtggaacttccgcaaggatgtcaacatgatcctgcagagttccctcggaaacgacctgcgcgtcgacggcgcctccgtccgcttcgacagcgtcaacctctacgccacattcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaagaaactccctccctcggctcgggtttcgatccctactttgtatactcgggttccatcccctacctcgacgggaccttctacctcaaccacaccttcaagaaggtctccatcatgttcgactcctcggtcagctggcccggcaacgaccggctgctcacgccgaacgagttcgagatcaagcgcagtgtcgacggggagggctacaatgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcacccaccatgcgtcaggggcagccctaccccgccaacttcccctatcctctcatcggccagacagccgtgccctctgtcacccagaaaaagttcctctgcgacagggtcatgtggcgcatccccttctccagcaacttcatgtccatgggcgccctcaccgacctgggtcagaacatgctctatgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggcttcctcgccggcgacaagctggcctgcgccattgtcaacacggccggccgcgagaccggaggcgtgcactggctcgccttcggctggaacccgcgctcgcgcacctgctacatgttcgacccatttgggttctcggaccgccggctcaagcagatttacagcttcgagtacgaggctatgttgcgccgaagcgccctggcttcctcgcccgaccgctgtctcagcctcgagcagtccacccagaccgtgcaggggcccgactccgccgcctgcggacttttctgttgcatgttcttgcatgccttcgtgcactggcccgaccgacccatggacgggaaccccaccatgaacttgctgacgggggtgcccaacggcatgctacaatcgccacaggtgctgcccaccctccggcgcaaccaggaggagctctaccgcttcctcgcgcgccactccccttactttcgctcccaccgcgccgccatcgaacacgccaccgcttttgacaaaatgaaacaactgcgtgtatctcaataaacagcacttttattttacatgtactggagtatatgcaagttatttaaaagtcgaaggggttctcgcgctcgtcgttgtgcgccgcgctggggagggccacgttgcggtactggaacttgggctgccacttgaactcggggatcaccagtttgggcactggggtctcggggaaggtctcgctccacatgcgccggctcatctgcagggcgcccagtatgtccggggcggagatcttgaaatcgcagttggggccggtgctctgcgcgcgcgagttgcggtacacggggttgcagcactggaacaccatcagactggggtacttcacactggccagcacgctcttgtcgctgatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacaaaggccgagatctgcttgaaagcttgctgggccttggccccctcgctgaaaaacaggccgcagctcttcccgctgaactggttattcccgcacccggcatcatgcacgcagcagcgcgcgtcatggctggtcagttgcaccacgctccgtccccagcggttctgggtcaccttggccttgctaggctgctccttcaacgcgcgctggccgttctcgctggtcacatccatctccaccacgtggtccttgtggatcatcaccgtcccgtgcaaacacttgagctggccttccacctcggtgcagccgtgatcccacagggcgcagccggtgcactcccaattcttgtgtgcgatcccgctgtggctgaagatgtaaccttgcaacaggcgacccatgacggtgctaaatgatttactggtgctgaaggtcagttgcagaccgcgggcctcctcgttcatccaggtctggcacatcttttggaagatctcggtctgctcgggcatgagcttgtaagcatcgcgcaggccgctgtcgacgcggtagcgttccataagcacgttcatggtatccatgcccttctcccaggacgagaccagaggcagactcagggggttgcgcacgttcagaataccgggggtcgcgggctcgacgatgcgttttccgtccttgccttccttcaacagaaccggcggctggctgaatcccactcccacgatcacggcatcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggaggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacttgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgttttcgcggtccccgaggcccttgccacctatcacatttttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccactttgcctaccccgccgtcaacctcccgcccaaggtcatgcgtcacatcatggatcagctcatcatgccccacatcgaagccctcgatgaaagtcaggagcagcgccccgaggacgcccgacccgtggtcagcgacgagatgctcgcgcgctggctcgggacccgcgagccccaggctttggaacagcggcgcaagctcatgctggccgtggtcctggtcaccctcgagctcgaatgcatgcgccgcttcttcagcgaccccgagaccctgcgcaaagtcgaggagaccctgcactacactttcagacacggtttcgtcaggcaggcctgcaagatttccaacgtggagctgaccaacctggtctcctgcctggggatcctgcatgagaaccgcctgggacagaccgtactccactctaccctgaagggcgaggcgcggagggactatgtccgcgactgcgtctttctctttctctgccacacatggcaagcagccatgggcgtgtggcagcagtgtctcgaggacgagaacctgaaggagctggacaagcttcttgctagaaaccttaaaaagctttggacgggcttcgacgagcgcaccgtcgcctcggacctggccgagatcgtcttccccgagcgcctgaggcagacgctgaaaggcgggctgcccgacttcatgagccagagcatgttgcaaaactaccgcactttcattctcgagcgatcggggatgctgcccgccacctgcaacgctttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctccttagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcggccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacacgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgcagctccggccaagcctcctcgtagatgggatcgagtgaagggcgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagagaagtcgccggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaagactactccacacgcatgaactggctcagtgccggcccctcgatgatatcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctcgggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactctgctgagctcgctcggttgaggcatctggaccactgccgccgcctgcgctgcttcgcccgggagagctgcggactcatctactttgagtttcccgaggagcaccccaacggtcctgcacacggagtgcggatcaccgtagagggcaccaccgagtctcacctggtcaggttcttcacccagcaacccttcctggtcgagcgggaccggggcgccaccacctacaccgtctactgcatctgtccgaccccgaagttgcatgagaatttttgctgtactctttgtggtgagtttaataaaagctaaactcttgcaatactctggaccttgtcgtcatcaactcaacgagaccgtctacctcaccaaccagactgaggtaaaactcacctgcagaccacacaagacctatatcatctggttcttcgagaacacctcatttgcagtctcaaacactcactgcaacgacggtgttgaacttccaaacaacctttccagtggactgagttacgatacacatagagctaagctcgtcctctacaatcctttcgtagagggaacctaccactgccagagcggaccttgcttccacagttttactttggtgaacgttaccggcagcagcacagccgctccagaacctaaccttccttctgatactatcaaacctcgtttcggaggtgagctaaggcttcccccttctgaggagggggttagcccatacgaagtggtcgggtatttgattttaggggtggtcctgggtgggtgcatagcggtgctagctcagctgccttgctgggtagaaatcaaaatctttatatgctgggtcagacattgtggggaggaactatgaaggggctcttgctgattatcctttccctggtggggggtgtgctgtcatgccacgaacagccacgatgtaacatcaccacaggcaatgagaggagtgtcatatgcacagtagtcatcaaatgcgagcatgaatgccctctcaacatcacattcaaaaaccgtaccatggggaatgcatgggtgggcgactgggaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggaaaacatggttgggttttctttggcttttgtgatcatggcctgctttatgtcaggtctgctggtaggagctctagtgtggttcctgaaacgcaagcccaggtatggaaatgaggagaaggaaaaattgctataaattctttttcttttcacagcaccatgaatactttgaccagtgtcgtgctgctctctcttcttgtagcttttagtcaggcaggaattattaacttaaatgtatcatggggaatgaatctaactttagtgggaccctcagacctgccagttacatggtatgatggaaagggaatgcagttttgtgatggaaatacaattaagaacccacaaatcaagcatagctgtaatcaacagaatctaactttacttaatgctgacaagtctcatgaaagaacttacctaggttacagacatgacagtaagggaaaagtagactataaggttacagtcataccacctcctccagccactcgcaagcctttgtcagagcctcattatgttactgtgactatgggcgataacataactttagtgggaccctcagacctgccagttacatggtatgatggagaaggaaataaattctgcgatggagaaaaagttgaacatgcagaatttaatcatacatgtaacatccagaacctgacactgctctttgtcaacttaacgcataatggagcatacattggttataacaaagacggttctgatagagaattatatgaggtgtcagtcaaaaccttgtttcagaacggggctggacaaagtaaggttgaacaaggtaataaagggaaacctaatactgctcaaagtggtggtaaaaaaaccaaaacagaacatagaaaccagagtccaaaaagaaaatcaacaaataaccttcagccaacacaattgtatgttaggccttttactaatgttagtttaactggacctccaaatggcaaggttacttggtatgatggcgaacttaatgatccatgtgaacaaaagtacaaactcagaactttttgcaatcagcaaaatctaactttaattaatgtaagcagcacttatgatggcatctattatggcactgatgaaaaagataaggcaaatcgttacagaataaaagtaaatactacaaatcacaaaactgttaaaattaagccacataccagagaacctcctgctgtacaagaaaaacagtttgaattacaagatgcagaaactgatgaaaacgaatcaaaaattccctcagctactgtggcaatcgtggtgggagtgattgcgggctttgtaactctgatcattgtcttcatatgctacatctgctgccgcaagcgtcccaggtcatacaatcatatggtagacccactactcagcttctcttactgaaactcagtcactctcatttcagaaccatgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatctgtgaatggaatgttactgcatataaatgcttcaataatggaagcattactattactgccactgccaacattacttctggcacatacaaagctgaaagctataaaaatgaaatcaaaaaactaacctataaaaacaacaaaaccacatttgaagattctggaaattatgaacatcaaaaattatctttttatatgttgacaataattgaactgcctacaactaaggctcccaccacaaccagtacaactattaagaccactactcacactacagtgcaaaatactactttattgattgggtttttactgagagagaatgaaagtactactgaacagacagaggctacctcaagtgccttcagcagcactgcaaatttaacttcgcttgcttggactaatgaaaccggagtatcattgatgcatggccagccttactcaggtttggatattcaaattacttttctggttgtctgtgggatctttattcttgtggttcttctgtactttgtctgctgcaaagccagagagaaatctaggaggcccatctacaggccagtgattggggaacctcagccactccaagtggatggaggcttaaggaatcttctcttctcttttacagtatggtgatcagccatgattcctaggttcttcctatttaacatcctcttttgtctcttcaacatctgtgctgccttcgcggccgtctcgcacgcctcgcccgactgtctagggcctttccccacctacctcctctttgccctgctcacctgcacctgcgtctgcagcattgtctgcgtggtcatcaccttcctgcagctcatcgactggtgctgcgcgcgctataattatctccaccacagtcccgaatacagggacgagaacgtagccagaatcttaaggctcatctgaccatgcagactctgctcatgctgctatccctcctatcccctgccctcgccacttctgctgactctaaatgcaaattcgcggagatatggaatttcttagattgctatcaggagaaaattgatatgccctcctattacttggtgattgtgggaatagtcatggtctgctcctgcactttctttgccatcatgatctacccctgttttgatctcggctggaactctgttgaggcattcacatacacactagaaagcagttcactagcctccacgccaccgcccacaccgcctccccgcagaaatcagttcccactgattcagtacttagaagagccccctccccggcccccttccactgttagctactttcacataaccggcggcgatgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgccttgtcaaacaggcaaagatcacctacgagctcgtgtccggcggcaagcagcatcgcctcacctatgagctgccccagcagaagcagaagttcacctgcatggtgggcgtcaaccccatagtcatcacccagcagtcgggcgagaccaacggctgcatccactgctcctgcgaaagccccgagtgcatatactccctcctcaagaccctttgcggactccgcgacctcctccccatgaactgatgttgattaaaagcacgaaaaccaatcagacccttcccccatttccccattcccaattactcataaaataaatcattggaattaatcattcaataaaaatcacttacttgaaatctgaaagtatgtctctggtgtagttgttcagcagcacctcgttaccctcctcccagctctggtattccagtccccggcgggcggcgaacttcctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcccccctttgtctcctccgatggattccaaaacttcccccctggggtcctgtcactcaaactggctgacccaatagccatcgtcaatgggaatgtctcactcaaagtgggagggggtctcactttgcaagatggaactggaaaactaacagtcaatgctgatccacctttgcaacttacaaacaacaaattagggattgctttggacgctccatttgatgttatagacaataaactcacattgttagcgggccatggcttgtctattataacaaaagaaacatcaacactgcctggcttgattaatactcttgtagtattaactggaaagggtattggaacagaatcaacagataatggcggaagcgtatgtgttagagttggagaaggtggcggcttatcatttaataatgatggagacttggtagcatttaataaaaaagaagataagcgcaccctatggacaactccagacacatctccaaattgcaagattgatcaagataaggactctaagttaactctggtccttacaaagtgtggaagtcaaatattggctaatgtgtcattaattgtcgtagctggtaagtacaaaattatcaataacaatactcaaccagctctcaaaggatttaccattaaattattgtttgatgaaaatggagtacttatggaatcttcaaatcttggtaaatcatattggaactttagaaatgaaaattcaattatgtcaacagcttatgaaaaagctattggattcatgcctaatttggtagcctatccaaaacctaccgctggctctaaaaaatatgcaagagatatagtttatggaaacatctaccttggtggaaagccagatcaaccagtaaccattaaaactacctttaatcaggaaactggatgtgaatattctatcacatttgattttagttgggccaagacttatgtaaatgttgaatttgaaacaacctcttttaccttttcctatatcgcccaagaatgaaagaccaataaacgtgtttttcatttcaaaattttcatgtatctttattgatttttacaccagcacgggtagtcagtctcccaccaccagcccatttcacagtgtacactgttctctcagcacgggtggccttaaatagggaaatgttctcattagtgcgggaactggacttggggtctataatccacacagtttcctggcgagccaaacgggggtcggtgattgagatgaagccgtcctctgaaaagtcatccaagcgagcctcacagtccaaggtcacagtctggtggaatgagaagaacgcacagattcatactcggaaaacaggatgggtctgtgcctctccatcagcgccctcagcagtctctgccgccggggctcggtgcggctgctgcagattggatcgggatcgcaagtctctctgactataatccccacagccttcagcatcagtctcctggtgcgtcgggcacagcaccgcatcctgatctctgccatgttctcacagtaagtgcagcacataatcaccatgttattcagcagcccataattcagggcgctccagccaaagctcatgttggggatgatggaacccacgtgaccatcgtaccagatgcggcagtatatcaggtgcctgcccctcataaacacactgcccatatacatgatctctttgggcatgtttctgttcacaatctgacggtaccaggggaagcgctggttgaacatgcacccgtaaatgactctcctgaaccacacggccagcagggtgcctcccgcccgacactgcagggagcccggggatgaacagtggcaatgcaggatccagcgctcgtacccgctcaccatctgagctctcaccaagtccagggtagcagggcacaggcacactgacatacatctttttaaaatttttatttcctctggggtcaggatcatatcccaggggactggaaactcttggagcagggtaaagccagcagcacatggtaatccacggacagaacttacattatgataatctgcatgatcacaatcgggcaacaggggatgttgttcagtcagtgaagccctggtttcctcatcagatcgtggtaaacgggccctgcgatatggatgatggcggagcgagctggattgaatctcggtttgcattgtagtggattctcttgcgtaccttgtcgtacttctgccagcagaaatgggcccttgaacagcagatacccctcctgcggccgtcctttcgctgctgccgctcagtcatccaactgaagtacatccattctcgaagattctggagaagttcctctgcatctgatgaaataaaaaacccgtccatgcgaattcccctcatcacatcagccaggactctgtaggccatccccatccagttaatgctgccttgtctatcattcagagggggcggtggcaggattggaagaaccatttttattccaaacggtctcgaaggacgataaagtgcaagtcacgcaggtgacagcgttcccctccgctgtgctggtggaaacagacagccaggtcaaaacccactctattttcaaggtgctcgaccgtggcttcgagcagtggctctacgcgtacatccagcataagaatcacattaaaggctggccctccatcgatttcatcaatcatcaggttacattcctgcaccatccccaggtaattctcatttttccagccttgaattatctctacaaattgttggtgtaagtccactccgcacatgtggaaaagctcccacagtgccccctccactttcataatcaggcagaccttcataatagaaacagatcctgctgctccaccacctgcagcgtgttcaaaacaacaagattcaataaggttctgccctccgccctgagctcgcgcctcaatgtcagctgcaaaaagtcacttaagtcctgggccactacagctgacaattcagagccagggctaagcgtgggactggcaagcgtaagggaaaactttaatgctccaaagctagcacccaaaaactgcatgctggaataagctctctttgtgtctccggtgatgccttccaaaatgtgagtgataaagcgtggtagtttttctttaatcatttgcgtaatagaaaagtcctctaaataagtcactaggaccccagggaccacaatgtggtagcttacaccgcgtcgctgaagcatggttagtagagatgagagtctgaaaaacagaaagcatgcactaaactaaggtggctatttttactgaaggaaaaatcactctctccagcaacagggtacccactgggtggcccttgcggacatacaaaaatcggtccgtgtgattaaaaagcagcacagtaagttcctgtcttcttccggcaaaaatcacatcggactgggttagtatgtccctggcatggtagtcattcaaggccataaatctgccctgatatccagtaggaaccagcacactcacttttaggtgaagcaataccaccccatgcggaggaatgtggaaagattcagggcaaaagaaggtatatctattgctagtcccttcctggacgggagcgatccctccaggactatctatgaaagcatacagagattcagccatagctcagcccgcttaccagtagacagagagcacagcagtacaagcgccaacagcagcgactgactacccactaacccagctccctatttaaaggcaccttacactgacgtaatgaccaaaggtctaaaaaccccgccaaaaaaacacacacgccctgggtgttttttcgcgaaaacacttccgcgttctcacttcctcgtatcgatttcgtgactcaacttccgggttcccacgttacgtcacttctgcccttacatgtaactcagtcgtagggcgccatgttgcccacgtccaaaatggtttccatgtccagccacgcctccgcggcgaccgttaacgccgtgcgtcgtgacgtcatttgcatcgtcttctctcgtccaatcagcgttggctccgccccgaaaccgttaaaattcaaaagctcatttgcatattaacttttgtttactttgtggggtatattatatagataggccaagctatttaggtgacactatagaatactcaagctatgcatcaagcttggtaccgagctcggatccactagtaacggccgccagtgtgctggaattcgcccttgtttaaacgcgatcg

SEQ ID NO: 20 - DNA, 35085 bp, Adenovirus D10
  MISC_FEATURE (1)..(35085): Complete Genome
catcatcaataatataccccacaaagtaaacaaaagttaatatgcaaatgaggttttaaatttagggcggggctactgctgattggccgagaaacgttgatgcaaatgacgtcacgacgcacggcgttaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgatccgcagggtatttaaaccagtcgagtccgtcaagaggccactcttgagtgccagcgagtagagatttctctgagctccgctcccagagaccgagaaaaatgagacacctgcgcctcctgccttcaactgtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaggaggctgtgaatttaatatttccagaatctatgattcttcaggctgacatagccaacgaatctactccacttcatacaccgactctgtcacccatacctgaattggaagaggaggacgaactagacctccggtgttatgaggaaggttttcctcccagcgattcagaggatgaacggggtgagcagaccatggctctgatctcagactatgcttgtgtgattgtggaggaacaagtagtgattgaaaattctaccgagccagtggagggctgtagaaaatgccagtaccaccgggataagtctggagacccgaacgcatcatgcgctttgtgctatatgaaacagactttcagctttatttacagtaagtggagtgaatgtgagagaggctgagtgcttaacacatcactgtgtattgcttgaacagctgtgctaagtgtggtttatttttgtttctaggtccggtgtcagaggatgagtcatcaccctcagaagaagaccacccgtctccccctgatctcacagatgacacgcccctgcaagtgcacagacccaccccagtcagagccagtggcgagaggcgagcagctgttgaaaaaattgaggacttgttacatgacatgggtggggatgaacctttggacctgagcttgaaacgccccaggaactaggcgcagctgcgcttagtcatgtgtaaataaagttgtacaataaaagtatatgtgacgcatgcaaggtgtggtttatgactcatgggcggggcttagtcctatataagtggcaacacctgggcactgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataaagaggaatttgaaaatatttttgctgactgctctggcctgctagattctctgaatcttggccaccagtcccttttccaggaaagggtactccacagccttgatttttccagcccagggcgcactacagccggggttgcttttgtggtttttctggttgacaaatggagccaggacacccaactgagcaggggctacatcctggacttcgcagccatgcacctgtggagggcctggatcaggcagcggggacagagaatcttgaattactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagttaagagggagaggagcgatgggggtaataccgggatgatgaccgagctgacggccagcctgatgaatcggaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttcttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacctgcgattcgggggtctgccatatcctgaagaacatccatgtgacctcccaccccagaaagaagtggccagtgtttgagaataacctgctgatcaagtgccatatgcacctgggagccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtcgagtgagtagtgggcgtggctaaggtgactataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggagctcgtcgctcgacagcaccgccgcagccgcggcagccgcagctgccatgacagcgacgagactggcctcgagctacatgcccagcagcggcagcagcccctctgtgcccagttccatcatcgccgaggagaaactgctggccctgctggccgagctggaagccctgagccgccagctggccgccctgacccagcaggtgtccgagctccgcgagcagcaacagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtctttgagaaggagactgatggccacggggagccccttggtgtaggtattggcgaagcggttgagctgggagggatgcatgcggggggagatgatgtgcagtttggcctggatcttgaggttggcgatgttgccacccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcattcatccatgatgatggcgatgggcccgtgggctgcggctttggcaaagacgtttctggggtcagatacatcataattatgctcctgggtgagatcatcataagacattttaatgaatttggggcggagggtgccagattgggggacgatggttccctcgggccccggggcgaagttcccctcacagatctgcatctcccaggctttcatctcggagggggggatcatgtccacctgcggggcgatgaaaaaaacggtttccggggctggggtgatgagctgcgaagagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccgaacgagctcgccgaggaggcggtccccgcccagcgagaggagctcttgcagggaagcaaagtttttcaggggcttgagtccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgggcccctggctgggcgcttgcaagggtgcgcttgagactcatcctgctggtgctgaaacgggcacggtcttcgccctgcgagtcggcgagatagcagttgaccatgagctcgtagttgagggcctcggcggcgtggcccttggcgcggagcttgcccttggaagagcgcccgcaggcgggacagaggagggattgcagggcgtagagcttgggggcgagaaagacggactcgggagcgaaagcgtccgctccgcagtgggcgcagacggtctcgcactcgacgagccaggtgagctctggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcctgccctgccgcgatgctttttaggagactttcatccatctggtcagaaaagacaatttttttattgtcaagcttggtggcgaaggagccatagagggcgttggagagaagcttggcgatggatctcattgtctgatttttgtcacggtcggcgcgctccttggccgcgatgttgagctggacatactcgcgcgcgacgcacttccattccgggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacggtggcagcacatcaagcagatgctcgtcaggggggtccgcatcgatggtgaagatgcccggacagagttccttgtcaaaataatctatttttgaggatgcatcatccaaggccatctgccactcgcgggcggccagcgctcgctcgtaggggttaaggggcggaccccagggcatgggatgcgtgagggcggaggcgtacatgccgcagatgtcatagacatagatgggctccgagaggatgccgatgtaggtgggataacagcgccccccgcggatgctggcgcgcacgtagtcatacaactcatgcgagggggccaagaaggcggggccgagattggtgcgctggggctgctcggcgcggaagacgatctggcgaaagatggcatgcgagttggaggagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttcgcggatgatgtcataacccgcttctcctttcttctcccacagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgtgcggccttgcggagcgaggtgtgcgtcagggcgaaggtgtccctgaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgctcgcggcatgaaattgcgggtgatgcggaaagggcccgggacggaggctcggttgttgatcacctgggcggcaaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcgggttcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggctttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcggcccatgagctgcgagaaggcgcccaggccgctctcgttccagacgcggctgtagaccacgtccccgtcggcgtcgcgtgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcattgcgggccgagaccgtgagctcgtcttccaggagcctgatgagctcggcgatggtggcgcgcacctcgcgctcgaaatccccgggggcctcctcttcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcaatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcatccatgtcgacgaagcggtggtaggccccggtgttgatggtgtaggtgcagttggccatgagcgaccagttgacggtctgcaggccgggttgcacgacctcggagtacctgatccgcgagaaggcgcgcgagtcgaagacgtagtcgttgcaggtgcgcacgaggtactggtagccgactaggaagtgcggtggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagggggtcgctagacttgaaagcggctgaaaaccccgccgggtagtggctcgcgcccgtagtctggagaagcatcgccagggttgagtcgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagacagagatggacttggaagagggcgaagggctggcaagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgaacagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcactgctgaacatcgccgagcccgagggtcgctggctgctggagctgatcaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctaagcgaccgcgagctgatgctgagccttcgccgggcgctggtagggggcgctgccggcggcgaggagtcctacttcgacatgggggcggacctgcattggcagccgagccggcgcgccttggaggccgcctacggtccagaggacttggaagaggatgaggaagaggaggaggatgcacccgctgcggggtactgacgcctccgtgatgtgtttttagatgcagcaagccccggaccccgccataagggcggcgctgcaaagccagccgtccggtatagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggttccccagagcgaggtgtaccagtctggcccggactactttttccagacgagccggcagggcttgcagacggtgaacctgagccaggctttcaagaacctgcgcgggctgtggggcgtgcaggcgcccgtgggcgaccggtcgacggtgagcagcttgctgacgcccaactcgcgtctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaacttcttgctgaccaatagacagcagaagatcccggcgcaatatgcgctgtcggccgaggaggaaaggatcctgagatatgtgcagcagagcgtagggctgttcctgatgcaggagggggccacccccagcgccgcgctggacatgaccgcgcgcaacatggaacctagcatgtacgccgccaaccggccgttcatcaataagctgatggactacctgcaccgcgcggcggtcatgaacacggactactttacaaacgccatcctgaacccgcactggctcccgccgccggggttctacacgggcgagtacgacatgcccgaccccaacgacgggttcctgtgggacgacgtggacagcgtggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccacgggccaagaacgccatggccaataacggtatagagagtctggtggacaaactgaaccgttggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtggctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcaaaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgtcatcgactcggtggtcgccgacgcgcgcaactacactcccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaattcgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgctaagggaaaagctcaaagaccagaactttcagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaaaggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgttgcacagtatcgtaggcctgggagtgaaaagtctgaagcgccgccgatgctattgaaagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagcctggcccccaagagcgcccccaatccaagtcagtggaccgccaatgaaaaacaaactggcggtcaaccaaaatctgttacccaaacatttggatctgctccaatgggaggcagcaatattactattgaaggattggttattggaactaaggaggaagaaggcaatgccactgaagaaatattcgcagataaaacattccagccagaacctcaagtaggagaagaaaactggcaggaaacagaagccttctatggaggaagggctcttaaaaaggataccaaaatgaaaccatgttacggttcatttgctagacccaccaatgaaaaaggagggcaagcaaaattaaagctcaacgatcagggtcagccaactaaagattatgacatagacctggcattctttgatactccgggcggaacacctccaacaggcagtggtcaacaggaagaatacaaagcagacattgttatgtacactgaaaatgtcaaccttgaaaccccagacacccacgtggtatataagccaggaaaagaggatgagagttctgaaacaaatttgacacagcagtccatgcccaacagacctaactacattggctttagggacaactttgtggggctcatgtattacaacagcaccggcaatatgggtgtgctggctggtcaggcttctcagttgaacgctgtggtcgacttgcaagacagaaataccgagctatcttaccagctattgctagattctttgggcgacaggaccagatactttagcatgtggaactctgcggtggacagctatgatcccgatgtcaggatcattgagaatcacggtgtggaagatgaacttccaaactattgcttcccattgaatggtactggcaccaattccacttatcaaggcgtaaaggtgaaaacaggtcaggatggagctgaggagaccgagtgggataaagatgaaactgttgcaagacaaaatcaaatcgccaagggcaacgtctatgccatggagatcaacctccaggccaacctgtggaagagttttctgtactcgaacgtagccctgtacctgcctgactcatacaagtacacgccggccaacgtcacgctgcccgccaataccaacacctacgagtacatgaacggccgcgtggtagccccctcgctggtggacgcctacatcaacatcggcgcccggtggtcgctggaccccatggacaacgtcaacccattcaaccaccaccgcaacgcgggcctgcgttaccgctccatgcttctgggcaacggccgctacgtgcccttccacatccaagtgccccaaaagttctttgccatcaagaacctgctcctgctccccggctcctacacctacgagtggaacttccgcaaggatgtcaacatgatcctgcagagttccctcggaaacgacctgcgcgtcgacggcgcctccgtccgcttcgacagcgtcaacctctacgccacattcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaagaaactccctccctcggctcgggtttcgatccctactttgtatactcgggctccatcccctatctcgatgggaccttctacctcaaccacaccttcaagaaggtctccatcatgttcgactcctcggtcagctggcccggcaacgaccggctgctcacgccgaacgagttcgagatcaagcgcagtgtcgacggggagggctacaatgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctacctcgcacccaccatgcgtcaggggcagccctatcccgccaacttcccctacccgctcatcggccagacagccgtgccctccgtcacccagaaaaagttcctctgcgacagggtgatgtggcgcatccccttctccagcaacttcatgtccatgggcgccctcaccgacctgggtcagaacatgctctacgccaactcggctcacgcgctcgacatgaccttcgaggtggaccccatggatgagcccaccctcctctatcttctctttgaagttttcgacgtggtcagagtgcaccagccgcaccgcggcgtcatcgaggccgtctacctgcgcacgcccttctccgccggcaacgccaccacctaagcatgagcggctccagcgaaagagagctcgcggccatcgtgcgcgacctgggctgcgggccctactttttgggtacccacgacaagcgcttcccgggcttccttgccggcgacaagctggcctgcgccatcgtcaacacggccggccgcgagaccgggggcgtgcactggctcgccttcggctggaacccgcgctcgcgcacctgctacatgttcgacccctttgggttctcggaccgccggctcaagcagatttacagcttcgagtacgaggccatgctgcgccgaagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctccggcgcaaccaggaggagctctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggaactggtacttgggctgccacttgaactcggggatcaccagtttgggcactggggtctcggggaaggtctcgctccacatgcgccggctcatctgcagggcgcccagcatgtcaggcgcggagatcttgaaatcgcagttggggccggtgctctgcgcgcgcgagttgcggtacactgggttgcagcactggaacaccatcagactggggtacttcacactagccagcacgctcttgtcgctgatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacgaaggccgcgatctgcttgaaagcttgctgggccttggccccctcgctgaaaaacaggccgcagctcttcccgctgaactgattattcccgcacccggcatcatggacgcagcagcgcgcgtcatggctggtcagttgcaccacgctccgtccccagcggttctgggtcaccttggccttgctgggttgctccttcagcgcacgctgcccgttctcactggtcacatccatctccaccacgtggtccttgtggatcatcaccgtcccatgcagacacttgagctggccttccacctcggtgcagccgtggtcccacagggcactgccggtgcactcccagttcttgtgcgcgatcccgctgtggctgaagatgtaaccttgcaacaggcgacccatgatggtgctaaagctcttctgggtggtgaaggtcagttgcagaccgcgggcctcctcgttcatccaggtctggcacatcttttggaagatctcggtctgctcgggcatgagcttgtaagcatcgcgcaggccgctgtcgacgcggtagcgttccatcagcacattcatggtatccatgcccttctcccaggacgagaccagaggcagactcagggggttgcgcacgttcaggacaccgggggtcgcgggctcgacgatgcgttttccgtccttgccttccttcaacagaaccggcggctggctgaatcccactcccacgatcacggcttcttcctggggcatctcttcgtctgggtctaccttggtcacatgcttggtctttctggcttgcttcttttttggagggctgtccacggggaccacgtcctcctcggaagacccggatcccacccgctgatactttcggcgcttggttggcagaggaggtggcggcgaggggctcctctcctgctccggcggatagcgcgctgaaccgtggccccggggcggagtggcctctcggtccatgaaccggcgcacgtcctgactgccgccggccattgtttcctaggggaagatggaggagcagccgcgtaagcaggagcaggaggaggacttaaccacccacgagcaaccaaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctcaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacatgcgagcccaacccgcgtctcaacttctatcccgtctttgcggtccccgaggccctcgccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggtgacaacgccaggctggccgtgctcaagcgcagcgtcgagctcacccactttgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgagccccaggctttggaacagcggcgcaagctcatgctggccgtggtcctggtcaccctcgagctcgaatgcatgcgccgcttcttcagcgaccccgagaccctgcgcaaggtcgaggagaccctgcactacactttcagacacggtttcgtcaggcaggcctgcaagatttccaacgtggagctgaccaacctggtctcctgcctggggatcctgcatgagaaccgcctgggacagaccgtactccactctaccctcaagggcgaggcgcggagggactatgtccgcgactgcgtctttctctttctctgccacacatggcaagcagccatgggcgtgtggcagcagtgtctcgaggacgagaacctgaaggaactggacaagcttcttgctagaaaccttaaaaagctttggacgggcttcgacgagcgcaccgtcgcctcggacctggccgagatcgtcttccccgagcgcctgaggcagacgctgaaaggcgggctgcccgacttcatgagccagagcatgttgcaaaactaccgcactttcattctcgagcgatcggggatgctgcccgccacctgcaacgctttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctccttagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgcagctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagaggagtcgccggaggaggcctgaggatcgcggcgaacgagccctcgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaagactactccacccgcatgaactggctcagtgccggcccctcgatgatatcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccgaccccgaagtcgcatgagaatttttgctgtactctttgtggtgagtttaataaaagctaaactcttgcaatactctggaccttgtcgtcatcaactcaacgagaccgtctacctcaccaaccagactgaggtaaaactcacctgcagaccacacaagacctatatcatctggttcttcgagaacacctcatttgcagtctcaaacactcactgcaacgacggtgttgaacttccaaacaacctttccagtggactgagttacgatacacatagagctaagctcgtcctctacaatcctttcgtagagggaacctaccactgccagagcggaccttgcttccacagttttactttggtgaacgttaccggcagcagcacagccgctccagaacctaaccttccttctgatactatcaaacctcgtttcggaggtgagctaaggcttcccccttctgaggagggggttagcccatacgaagtggtcgggtatttgattttaggggtggtcctgggtgggtgcatagcggtgctagctcagctgccttgctgggtggaaatcaaaatctttatatgctgggtcagacattgtgggaaggaactatgaaggggctcttgctgattatcctttccctggtggggggtgtgctgtcatgccacgaacagccacgatgtaacatcaccacaggcaatgagaggaacgactgctctgtagttattaaatgcgagcaccattgtcctctcaacatcacattcaagaataagaccatgggaaatgtatgggtgggattctggcaaccaggagatgagcagaactacacggtcactgtccatggtagcgatggcaatcacactttcggtttcaaattcatttttgaagtcatgtgtgatatcacactacatgtggctagacttcatggcttgtggccccctaccaaggagaacatggtgggtttttctttggcttttgtgatcatggcctgcttgatgtcaggtctgctggtaggggctctagtgtggtttctgaagcgcaagcccaggtacggaaatgaggagaaggaaaaattgctataaattctttttctcttcgcagaaccatgaatacagtgttccgtatcgtgctgctctctcttcttgtagctttcggtcaggcaggaattcatattattaatgctacatggtgggataatataactttagtgggaccctcagatactccagttacctggtatgatggcaatggattgcaattttgtgacggaagtacagttaagaatccgcagataagacatacttgtaatgatcaaaacttaactctgattcatgttaacaaaacccatgaaagaacatacatgggttacagacatgacagtaagggaaaagtagactataaggttacagtcattccacctcctcctgctactgtaaagccacaaccagatccagaaaatgtctttgtttatatgggagataatgtaactttagttggacctccaggaattccagttagttggtattatcataatggcacacagttctgcgatggagataaaattattcatccagaattcaaccacacctgtgataaacaaaaccttacactgctgtttgtaaactttacacatgacggaggctatcttggattcaattacaaaggtactaaaagaactcagtatgaggttatagttttagatcgatttccaaattctggtcagatgaaaattgaagaacaaagtgaggaaacagaacagaaacatactgagcaaaataaggctggacaaaagcagggtatagatacaaatcaaaagaaatctaataacagacaaaagccatctcaaaggccatcaagaagacggccgacaaacactcctgagacaaaacaacttacagtgtctattgggtctaacttaactttagttggtccagatggaaaagtcacttggtatgatggtgatttaaaaagaccatgtgaagaacaaaactataggcttccacatcagtgtagtactcagaacttaactttaattaatgtaactaaatctcatgagggaacttactatggcactaatgacaaagacgaaagcaaaagatacagagtgaaagtgaacactacaaattctcaagctgtaaaaattaacccatataccagacctactactcctgatcagaaacacagatttgaattgcaaattgaaaataatgcaaatgatgaagaatcaaaaattccatctactactgtggcaatcgtggtgggagtgattgcgggcttcataactataatcattgtcattctgtgctacatctgctgccgcaagcgtcccagggcatacaatcatatggtagacccactactcagcttctcttactgagactcagtcactttcatttcagaaccatgaaggctttcacagcttgcgttctgattagcctagtcacacttagttcagctgcaggatatactcaagttaatgttactagagatggtagtataaatcttaaaggaccatacactaataccacatggtccagatttcacttgaacgcatggcaatttatttgcacatggaatgtgacagcatatgtatgtcacaaaaatggaagcattaccatcacagctcaaaagaacataacttctggagtattgaaagccgatgggtttcatgtaaattcatatggatatgaaaatcaaaaactgattttatataatttaacaatcattgagcatccaaccactaaagcgccaactactactaggcccaccacaattaggtcaaccatggaaacaaccacgcagcctaccactactcatactacacagatagacacaacactacagaatactactttattaattggatttttactgagagagaatgaaagtactactgatcagacagaggctacctcaagtgccttcagcagcactgcaaatttaacttcgcttgcttggactaatgaaaccggagtatcattgatgaatcgtcagcctttctcaggtttggatattcaaattacttttctggttgtctgtgggatctttattcttgcggttcttctgtactttgtctgctgcaaagccagagagaaatctaggaggcccatctacaggccagtaatcggggagcctcagcccctccaagtggatggaggcttaagaaatcttctcttctcttttacagtatggtgatcagccatgattcctaggttcttcctatttaacatcctcttctgtctcttcaacatctgtgctgccttcgcggccgtctcgcacgcctcgcccgactgtctcgggcccttcccaacctacctcctctttgctctgctcacctgcacctgcgtctgcagcattgtctgcctggtcatcaccttcctgcagctcatcgactggtgctgcgcgcgctacaattatctccatcacagtcccgaatacagggacgagaacgtagccagaatcttaaggctcatctgaccatgcagactctgctcatgctgctatccctcctatcccctgccctagccacttctgctgattactctaagtgcaaattcgcagacatatggaatttcttagattgctatcaggaaaaaattgatatgccctcctattacttggtgattgtgggaatagtcatggtctgctcctgcactttctttgccatcatgatctacccctgttttgatctcggctggaactctgttgaagcattcacatacacactagaaagcagttcactagcctccacgccaccgcccacaccgcctcctcgcagaaatcagttcccactgatacagtacttagaagagccccctccccgacccccttccactgttagctactttcacataaccggcggcgatgactgaccacctggacctcgagatggacggccaggcctccgagcagcgcaccctgcaactgcgcgttcgtcagcagcaggagcgggccgccaaggagctcctcgatgccatcaacatccaccagtgcaagaagggtatcttctgcctggtcaaacaggcaaagatcacctacgagctcctgtccggcggcaagcagcatcgcctcgcctatgagctgcctcagcagaagcagaagttcacctgcatggtgggcatcaaccccatagtcatcacccagcagtcgggcgagaccagcggctgcatccactgctcctgtgaaagccccgagtgcatctactccctgctcaagaccctttgcggactccgcgacctcctgcccatgaactgatgttgattaaagcccagaaaccaatcaaacccctttgcccaaataaacaatcattggaaataatcattcaataaagatcacttacttgaaatctgaaagtatgtctctggtgtagttgttcagcagcacctcggtaccctcctcccagctttggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattccaaaacttcccccctggggtcctgtcactcaaactggctgacccaatcgctatcaccaatgggaatgtctcactcaaggtgggagggggacttactgtagagcaacagactggaaacctaagtgtgaaccctgccgcccccttgcaagttgcaagtgataagctacagcttgtcctagctcctccatttgaggtaaaagacggaaaactttcattaaaaacaggcaatggattaaaagtaatagataaaagcatcacagacctaccaggattaatagatacacttgctgttttaactggaaagggaattggaacagaagaactaaaaaatgaaaatggaactaataaaggtgttggtttgcgcgttagactcgctgatgacggtggattaacatttgatgaaaagggtgacctcgtagcatggaatgttaagcatgacactcgcaccctttggacaacaccagacacttctccaaactgcacaattgctcaggataaggactctaaactaactcttgttcttacaaagtgcggaagtcaaatattggcaaatgtgtctttgattgtggtcgcaggaaagtaccacatcataaataataagaataatccagaaataaaaagttttactattaaacttctatttgataagaacggagtgcttttagacaactcaaatcttggaaaaacttattggaactttagaagtggagattccaatgtttcgacagcttatgaaaaagcaattggttttatgcctaatttggtagcgtatccgaaacccagtaattctaaaaaatatgcaagagacatagtttatggaactatatatcttggtggaaaacctgatcagccagcagtcattaaaactacctttaaccaagaaactggatgtgaatactctataacatttgactttagttggtccaaaacctatgaaaatgttgaatttgaaaccacctcttttaccttctcctatatcgcccaacaatgaaagaccaataaacgtgtttttcatttgaaaattttcatgtatctttattgatttttacaccagcacgggtagtcagtctcccaccaccagcccatttcacagtgtaaacaattctctcagcacgggtggccttaaatagggcaatattctgattagtgcgggaactggacttggggtctataatccacacagtttcctggcgagccaaacgggggtcggtgattgagatgaagccgtcctctgaaaagtcatccaagcgagcctcacagtccaaggtcacagtctggtggaatgagaagaacgcacagattcatactcggaaaacaggatgggtctgtgcctctccatcagcgccctcagcagtctctgccgtcggggctctgtgcggctgctgcagatgggatcgggatcgcaagtctctctgactataatccccacagccttcagcatcagtctcctggtgcgtcgggcacagcaccgcatcctgatctctgccatgttctcacagtaagtgcagcacataatcaccatgttattcagcagcccataattcagggcgctccagccaaagctcatgttggggatgatggaacccacgtgaccatcgtaccagatgcggcagtatatcaggtgcctgcccctcataaacacactgcccatatacatgatctctttgggcatgtttctgttcacaatctgacggtaccaggggaagcgctggttgaacatgcacccgtaaatgactctcctgaaccacacggccagcagggtgcctcccgcccgacactgcagggagcccggggatgaacagtggcaatgcaggatccagcgctcgtacccgctcaccatctgagctctcaccaagtccagggtagcagggcacaggcacactgacatacatctttttaaaatttttatttcctctggggtcaggatcatatcccaggggactggaaactcttggagcagggtaaagccagcagcacatggtaatccacggacagaacttacattatgataatctgcatgatcacaatcgggcaacaggggatgttgttcagtcagtgaagccctggtttcctcatcagatcgtggtaaacgggccctgcgatatggatgatggcggagcgagctggattgaatctcggtttgcattgtagtggattctcttgcgtaccttgtcgtacttctgccagcagaaatgggcccttgaacagcagatacccctcctgcggccgtcctttcgctgctgccgctcagtcatccaactgaagtacatccattctcgaagattctggagaagttcctctgcatctgatgaaataaaaaacccgtccatgcgaattcccctcatcacatcagccaggactctgtaggccatccccatccagttaatgctgccttgtctatcattcagagggggcggtggcaggattggaagaaccatttttattccaaacggtctcgaaggacgataaagtgcaagtcacgcaggtgacagcgttcccctccgctgtgctggtggaaacagacagccaggtcaaaacccactctattttcaaggtgctcgaccgtggcttcgagcagtggctctacgcgtacatccagcataagaatcacattaaaggctggccctccatcgatttcatcaatcatcaggttacattcctgcaccatccccaggtaattctcatttttccagccttgaattatctctacaaattgttggtgtaagtccactccgcacatgtggaaaagctcccacagtgccccctccactttcataatcaggcagaccttcataatagaaacagatcctgctgctccaccacctgcagcgtgttcaaaacaacaagattcaataaggttctgccctccgccctgagctcgcgcctcaatgtcagctgcaaaaagtcacttaagtcctgggccactacagctgacaattcagagccagggctaagcgtgggactggcaagcgtaagggaaaactttaatgctccaaagctagcacccaaaaactgcatgctggaataagctctctttgtgtctccggtgatgccttccaaaatgtgagtgataaagcgtggtagtttttctttaatcatttgcgtaatagaaaagtcctctaaataagttactaggaccccagggaccacaatgtggtagcttacaccgcgtcgctgaagcatggttagtagagatgagagtctgaaaaacagaaagcatgcactaaactaaggtggctattttcactgaaggaaaaatcactctctccagcaacagggtacccactgggtggcccttgcggacatacaaaaatcggtccgtgtgattaaaaagcagcacagtaagttcctgtcttcttccggcaaaaatcacatcggactgggttagtatgtccctggcatggtagtcattcaaggccataaatctgccctgatatccagtaggaaccagcacactcacttttaggtgaagcaataccaccccatgcggaggaatgtggaaagattctgggcaaaagaaggtatatctattgctagtcccttcctggacgggagcgatccctccaggactatctatgaaagcatacagagattcagccatagctcagcccgcttaccagtagacagagagcacagcagtacaagcgccaacagcagcgactgactacccactaacccagctccctatttaaaggcaccttacactgacgtaatgaccaaaggtctaaaaaccccgccaaaaaaacacacacgccctgggtgttttttcgcgaaaacacttccgcgttctcacttcctcgtatcgatttcgtgactcaacttccgggttcccacgttacgtcacttctgcccttacatgtaactcagtcgtagggcgccatgttgcccacgtccaaaatggtttccatgtccagccacgcctccgcggcgaccgttaacgccgtgcgtcgtgacgtcatttgcatcaacgtttctcggccaatcagcagtagccccgccctaaatttaaaacctcatttgcatattaacttttgtttactttgtggggtatattattgatgatg

SEQ ID NO: 21 - DNA, 35218 bp, Adenovirus D13
  MISC_FEATURE (1)..(35218): Complete Genome
catcatcaataatataccccacaaagtaaacaaaagttaatatgcaaatgaggttttaaatttagggcggggctactgctgattggccgagaaacgttgatgcaaatgacgtcacgacgcacggctaacggtcgccgcggaggcgtggcctagcccggaagcaagtcgcggggctgatgacgtataaaaaagcggactttagacccggaaacggccgattttcccgcggctacgcccggatatgaggtaattctgggcggatgcaagtgaaattaggtcattttggcgcgaaaactgaatgaggaagtgaaaagtgaaaaataccgggcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagaccgagaaaaatgagacacctgcgccttctaccttcaactgtgcccggcgacctggctgtgataatgctggaggactttgtgaatacagttctggaggacgaactgcatccaacaccgttcgagctgggacccacacttcaggatctctatgatctggaggtagatgcccatgatgacgaccctaatgaagaggctgtgaatttaatatttccagaatctatgattctccaggctgacatagccagcgaagctgtagttactccacttcataccccgactctgccaccaatacctgaattggaagaggaggacgagctagaccttcggtgttatgaggaaggttttcctcccagcgattcagaggacgaacagggtgagcagagcatggctctaatctcagactatgcttgtgtgattgtggaggagcaagatgtgattgaaaaatctactgagccagtacaaggctgtaggaactgcaagtaccaccgggataagtccggagatccaaaagcctcatgtgctctgtgctatatgaaacagactttcagctttatttacagtaagtagagtgaatgcgagagagactgagtgcttaacacatatctgtgtgttgcttgaacagctgtgctaagtgtggtttatttttgttactaggtcctgtgtcagaggatgagtcatcgccctcagaagaagaccacccgtctccccctgagctgtcaggcgaaacgcccctgcaagtgcacagacccaccccagtcagacccagtggcgagaggcgagcagctgttgaaaaaattgaggacttgttgcatgacatgggtggggatgaacctttggacctgagcttgaaacgccccaggaactaggcgcagatgcgcttagtcatgtgtaaataaagttgtacaataaaaattatatgtgacgcatgcaaggtgtggtttatgactcatgggcggggcttagtcctatataagtggcaacacctgggcactcaggcacagaccttcagggagttcctgatggatgtgtggactatccttgcggactttaacaagacacgccggcttgtagaggatagttcagacgggtgctccggtttctggagacactggtttggaactcctctatctcgcctggtgtacacagtaaagaaggattatcaggaggaatttgaaaatcttttttgctgactgctctggcctgcttgattctctgaatttcggccaccagtcccttttccaggaaagggtcctccacagccttgatttttccagcccagggcgcactacagccggggttgcatttgtggtttttctggttgacaaatggagccaggacacccaactgagcaggggctacatcctggacttcgcagccatgcacctgtggagggcctggatcaggcagcggggacagagaatcttgaactactggcttctacagccagcagctccgggtcttcttcatctacacagacaaacatccatgttggaggaagaaatgagggaggccatggacgagaacccgaggagcggcctggaccctccgtcggaagaggagctggattgaatcaggtatccagcctatacccagagcttagcagggtcctgaccaacggatccataggtgcgaggggagtgaagagggagaggagcgatggtggcaataccgggatgatgaccgagctgactgccagcctgatgaatcgcaagcgcccagagtgcattacctggcatgagctacagatggagtgcagggatgaggtgggcctgatgcaggataaatatggcctggagcagataaaaactcactggttgaacccagatgaggattgggaggaggccattaagaagtatgctaagatagccctgcgcccagattgcaagtacaggatcactaagacggtgaatatcagacatgcctgctacatctcagggaatggggcagaggtggtcatcgataccctggacaagtctgccttcaggtgttgcatgatgggaatgagagccggtgtgatgaatatgaattccatgatcttcatgaacatgaagtttaatggagagaagtttaacggggtgctgttcatggccaacagccatatgaccctgcatggctgcaagttcttcggattcaacaatatgtgtgcagaggtgtggggctcagccaagatcaggggctgtgtgtattatggttgctggatgggcgtggtcggaagacccaagagcgagatgtctgtaaagcagtgtgtgtttgagaagtgctacctgggagtctctaccgagggcaatgctcgggtgagacactgttcttccatcgagacgggctgcttctgcctggtgaagggcacagcctcgctcaagcataatgtgatcaaggggtgcacggatgagcgcatgtacaacatgctgacctgcgactcgggtgtctgccatatcctgaagaacatccatatcacctcccacgctagaaagaagtggccagtgtttgagaataacatgctgatcaagtgccatgtgcacctgggtgtcagaaggggcaccttccagccgtaccagtgcaactttagccagaccaagctgctgctggagagcgatgccttctccagggtgaacctgaacggcatctttgacatggatgtctcggtgtacaagatcctgagatacgatgagaccaggtccagggtgcgcgcttgcgagtgcggaggcagacacaccaggatgcaaccagtggccctggatgtgaccgaggagctgaggcccgaccacctggtgatggcctgtaccgggaccgagttcagctccagcggggaggacacagattagaggtaggttgagtgagtagtgggcgtggctaaggtgactataaaggtgggtgtcttacgagggtctttttgcttttctgcagacatcatgaacgggaccggcggggccttcgaaggggggcttttcagcccttatttgacaacccgcctgccgggatgggccggagttcgtcagaatgtgatgggatcgacggtggatgggcgcccagtgcttccagcaaattcctcgaccatgacctacgcgaccgtggggacgagctcgtcgctcgacagcaccgccgcagccgcggcagccgcagccgccatgacagcgacgagactggcctcgagctacatgcccagcagcggtagcagcccctccgtccccagttccatcatcgccgaggagaaactgctggccctgctggccgagctggaagccctgagccgccagctggccgccctgacccagcaggtgtccgagctccgcgagcaacagcagcagcaaaataaatgattcaataaacacagattctgattcaaaagcaaagcatctttattatttattttttcgcgcgcgataggccctggtccacctctcccgatcattgagagtgcggtggattttttccaagacccggtagaggtgggattggatgttgaggtacatgggcatgagcccgtcccggggatggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcgaagcggttgagctgggagggatgcatgcggggggagatgatgtgcagtttggcctggatcttgaggttggcgatattgccgcccagatcccgccgggggttcatgttgtgcaggaccaccaggacggtgtagcccgtgcacttggggaatttgtcatgcaacttggaagggaatgcgtggaagaatttggagacgcccttgtgcccgcccaggttttccatgcactcatccatgatgatggcaatgggcccgtgggctgcggctttggcaaagacgttcctgggatcagagacatcgtaattatgctcctgggtgagatcatcataagacattttaatgaatttggggcggagggtgccagattgggggacaatggttccctcgggccccggggcgaaattcccctcgcatatctgcatctcccaggctttcatctcggaggggggaatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggagatgcagctgccgtcgtcccggaggaggggggccacctcgttaagcatgtccctgacttggaggttttcccggacgagctcgccgaggaggcggtccccgcccagcgagaggagctcttgcagggaagcaaagtttttcaggggcttgagcccgtcggccatgggcatcttggcgagggtctgcgagaggagttccaagcggtcccagagctcggtgacgtgctctacggcatctcgatccagcagacttcctcgtttcgggggttgggacgactgcgactgtaaggcacgagacgatgggcgtccagcgctgccagcgtcatgtccttccagggtctcagggtccgcgtgagcgtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcctttggaagagcgcccgcaggcgggacagaggagggattgcaaggcgtagagcttgggcgcgagaaagacggactcgggggcaaaggcgtccgctccacagtgggcgcagacggtctcgcactccacgagccaggtgagctcgggctgctcggggtcaaaaaccagttttcccccgttctttttgatgcgcttcttacctcgcgtctccatgagtctgtgtccgcgctcggtgacaaacaggctgtcggtgtccccgtagacggacttgatgggcctgtcctgcaggggcgtcccgcggtcctcctcgtagagaaactcggaccactctgagacgaaggcgcgcgtccacgccaagacaaaggaggccacgtgcgaggggtagcggtcgttgtccaccagggggtccaccttttccaccgtgtgcaggcacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaagtattccctctcgagagcgggcatgacctcggcactcaggttgtcagtttctagaaacgaggaggatttgatgttagcttgccctgccgcgatgcttttcaggagactttcattcatctggtcagaaaagactatttttttattgtcaagcttggtggcgaaggagccatagagggcgtttgaaagtagcttggcgatggatctcatggtctgatttttgtcacggtcggcgcgctccttggccgcgatgttgagctggacatactcgcgcgctacgcacttccattcggggaagacggtggtgcgctcgtctggcacgatcctgacgcgccagccgcggttatgcagggtgaccaggtccacgctggtggccacctcgccgcgcaggggctcattcgtccagcagaggcgcccgcccttgcgcgagcagaaagggggcaacacatcaagcagatgctcgtcaggggggtccgcatcgatagtgaagatgcccggacagagttccttgtcaaaataatcgatttttgaggatgcatcatccaaggccatctgccactcgcgggcggccagcgctcgctcgtagggattgaggggcggaccccagggcatgggatgcgtgagcgcggaggcgtacatgccgcagatgtcatagacatagatgggctccgagaggatgccgatgtaggtgggataacagcgccccccgcggatgctggcgcgcacatagtcatacaactcgtgcgagggtgccaaaaaggcggggccgagattggtgcgttgcggctgctcggcgcggaagacgatctggcgaaagatggcatgcgagttggaagagatggtgggcctttggaagatgttaaagtgggcgtgaggcaggcggaccgagtcgcggatgaagtgcgcgtaggagtcttgcagcttggcgacgagctcggcggtgacgaggacgtccatggcgcagtagtcgagcgtttcgcggatgatgtcataacccggctctcctttcttctcccacagctcgcggttgagggcgtactcctcgtcatccttccagtactcccggagcgggaatcctcgatcgtccgcacggtaagagcccagcatgtagaattggttcacggccttgtagggacagcagcccttctccaccgggagggcgtaagcttgagcggccttgcggagcgaggtgtgcgtcagggcgaaggtgtccctgaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcgaagccgttgatgttgtgcccgacgatgtaaagttccatgaatcgcgggcggcctttgatgtgcggcagctttttgagctcctcgtaggtgaggtcctcggggcattgcaggccgtgctgctcgagcgcccactcctggagatgtgggttggcacgcatgaaggaagcccagagctcgcgggccatgagggtctggagctcgtcgcgaaagaggcggaactgttggcccacggccatcttttcgggggtgacgcagtagaaggtgagggggtcccgctcccagcgatcccagcgtaagcgcacggcgagatcgcgagcgagggcgaccagctcggggtccccggagaatttcatgaccagcatgaaggggacgagctgcttgccgaaggaccccatccaggtgtaggtttctacatcgtaggtgacaaagagccgctccgtgcgaggatgagagccgatggggaagaactggatttcctgccaccagttggacgagtggctgttgatgtgatgaaagtagaaatcccgccggcgaaccgagcactcatgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggttgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggccgtgtccacgcattgcatgagcccgtagctgcgcggggccacgaccgtgccgcgctttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctcgacggtggcggcgaggtcgttggagatgcgacccatgagctgcgagaaggcgcccaggccgctctcgttccagacgcggctgtagaccacgtccccgtcggcgtctcgcgcgcgcatgaccacctgcgcgaagttgagctccacgtgccgcgcgaagacggcgtagttgcgcaggcgctggaagaggtagttgagggtggtggcgatgtgctcggtgacaaagaagtacatgatccagcggcgcaggggcatctcgctgatgtcgccgatggcctccagcctttccatggcctcgtagaagtccacggcgaagttgaaaaactgggcgttgcgggccgagaccgtgagctcgtcttccaggagccggatgagctcggcgatggtggcgcgcacctcgcgctcgaaatccccgggggcctcctcctcttcctcttcttcttccatgacgacctcttctatttcttcctctgggggcggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgactatgcatcttatcaattgcggtgtaggggacgtgagcgcgtcgagatcgaccggatcggagaatctttcgaggaaagcgtctagccaatcgcagtcgcaaggtaagctcagacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggccccggtgttgatggtgtaggtgcagttggccatgagcgaccagttgacggtctgcaggccgggctgcacgacctcggagtacctgagccgcgagaaggcgcgcgagtcgaagacgtagtcgttgcaggtgcgcacgaggtactggtagcccactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttcagcgggctcttcctccgtagcctggcggaacgcaaacgggttaggccgcgcgtgtaccccggttcgagtcccctcgaatcaggctggagccgcgactaacgtggtattggcactcccgtctcgacccgagcccgatagccgccaggatacggcggagagccctttttgcaggccgcgcggggtcgctagacttgaaagcggccgaaaaccccgccgggtagtggctcgcgcccgtagtctggagaagcatcgccagggttgagtcgcggcagaacccggttcgcggacggccgcggcgagcgggaattggtcaccccgcctatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagaaatggacttggaagagggcgaagggctggcgagactgggggcgccgtccccggagcgacacccccgcgtgcagctgcagaaggacgtgcgcccggcgtacgtgcccgcgcagaacctgttcagggaccgcagcggggaggagcccgaggagatgcgcgactgccggtttcgggcgggcagggagctgcgcgatggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggccctgggtctgatgcacctgtgggacctggcggaggccatcgtgcagaacccggacagcaagcctctgacggcgcagctgttcctggtggtgcagcacagcagggacaatgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccttacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagcctgcgccgggcgctggtaggaggcgccaccggcggcgaggagtcctacttcgacatgggggcggacctgcattggcagccgagccggcgcgccttggaggccgcctacggtccagaggacttggatgaggatgaggaagaggaggaggatgcacccgttgcggggtactgacgcctccgtgatgtgtttttagatgtcccagcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgttggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccggactactttttccagacgagccggcagggcttgcagacggtgaacctgagccaggctttcaagaatctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtatagggaggccataggccaggcgcaggtggacgagcagacattccaggagatcacgagcgtgagccgcgcgctggggcagaacgacaccgacagtctgagggccaccctgaacttcttgctgaccaatagacagcagaagatcccggcgcagtacgcactgtcggccgaggaggaaaggattctgagatatgtgcagcagagcgtagggctgttcctgatgcaggagggggccacccccagcgccgcgctggacatgaccgcgcgcaacatggaacctagcatgtacgccgccaaccggccgttcatcaataagctgatggactacctgcaccgcgcggcggccatgaacacggactactttaccaacgccatcctgaacccgcactggctcccgccgcctgggttctacacgggcgagtacgacatgcccgaccccaacgacgggttcctgtgggacgacgtggacagcgcggtgttctcgcccgcctttcaaaagcgtcaggaagcggtgcgcacgcctagcgagggcgcggtgggacggagcccctttcctagcttggggagtttgcatagcctgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggtggggccaacccgttcgcgcatctgcagcccagactggggcggcggatgttttgaaatgcaaaataaaactcaccaaggccatagcgtgcgttctcttccttgttagagatgaggcgcgcggtggtgtctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcccggtggggcggtgatctgaagaccattctgcacaccaacatgcccaatgtgaacgagtacatgttcaccagcaagtttaaggcgcgggtgatggtggctaggaagcatccagagggggtagaagcaaccgatttaagcaaggatatcttagagtatgattggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtgaccaagctggtgatgccaggtgtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagtagggggcaatatcccagccctcctggatgtcaagaagtatctgaaggataaggaagaagctggcactacagatgcaaataccattaaggctcagaatgatgcagtcccaagaggagacaactttgcttcagcggcagatgccaaagcggcaggaaaagaaattgagttgaaagccattttaaaagatgattcaggcagaagctacaatgtgatcgagggaaccacggacaccctgtaccgaagttggtacctgtcctatacctacggggaccccgagaagggggtgcagacgtggacgctgctcactaccccggacgtcacctgcggcgcggagcaagtctactggtcgctgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagtacgcccgccatgcgcgccgcccgggctctgctgcgccgcgccagacgcacgggccgccgggccatgatgcgagccgcgcgccgcgctgccgctgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggaagtgctggacagcgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcagaccgacccctggctcccagcttctaccgccaccgcctctacatctaccgccgccacggctaccgagcctcccaggaggcgaagatggggcgccgccagccggctgatgcccaactacgtgttgcatccttccatcatcccgacgccgggctaccgcggcacccggtactacgccagccgcaggcgcccagccagcaaacgccgccgccgcaccaccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatgacaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgtctggacccgcgcccgcccgccgccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacctacgcccgctccaccgaaagcagctccggttgtgcagccccctccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacgtactttgacatccgcggcgtcctggaccgcggtcccagcttcaaaccctactcgggcacggcttacaacagcctggcccccaagggcgcccccaatcccagtcagtggactactaaagaaaagcagaccggagtaaatgcaggagacaaagaagttaccaagacatttggaattgccgccatgggaggcagtaatatttctgaaaacggtttgcagattggaactgacacaacagcagatggcacaaaaccaatatatgcagacaaaactttccagccagaacctcaagttggagaagaaaactggcaggataatgatgaatattatggaggcagggctcttaaaaaagataccaaaatgaagccatgctatggttcatttgctaaacccacaaacaaggaaggagggcaggctaaattgaaagaaacacccaatggcgctgatcctcaatatgatgtggacatggctttctttgactcaacaactataaacattccagatgtagtgttgtacactgaaaatgtagacttggaaactccagacacacatgtggtgtacaaaccaggcaaagaggatgacagttcagaagtaaacttaactcagcagtccatgcctaacagacccaactacattggcttcagagacaactttgtggggctcatgtactacaacagcactggcaacatgggtgtgctggctggtcaggcttctcagttgaatgctgtggttgacttgcaagacagaaacaccgaactgtcttaccagctcttgctagattctctgggtgacagaacaagatactttagcatgtggaactctgcggtggacagttatgatcccgatgtcaggatcattgaaaatcacggtgtggaagatgaacttccaaactactgcttccccttggacggtattcaaactaattcagcctaccaaggtgttaaactaaaggataatccaacaggaggcggagctaatggagattgggtaaaggatgataccatttcagcccataatcaaattgggaagggcaacatctttgccatggagatcaacctccaggccaacctctggaagagttttctgtactcgaacgtggccttgtacctgcccgactcctacaagtacacgccggccaacgtcacgctgcccgccaacaccaacacctacgagtacatgaacggccgcgtggtagccccctcgctggtggacgcctacatcaacatcggcgcccgctggtcgttggaccccatggacaacgtcaaccccttcaaccaccaccgcaacgcgggcctgcgctaccgctccatgcttctgggcaacggccgctacgtgcccttccacatccaagtgccccaaaagttctttgccatcaagaacctgctcctgcttcccggctcctacacctacgagtggaacttccgcaaggatgtcaacatgatcctgcagagttccctcggcaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcactcgtctgaagaccaaggaaactccctctctcggttcgggtttcgacccctactttgtctactcgggctccattccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgaaatcaactacaaggactacaaggccgtcaccctgcccttccagcacaacaactcgggcttcaccggctacctggcccccaccatgcgtcaggggcagccctaccccgccaacttcccctacccgctcatcggctccaccgcagtcccctccgtcacccagaaaaagttcctctgcgacagggtcatgtggcgcatccccttctccagcaacttcatgtccatgggcgccctcaccgacctgggtcagaacatgctctatgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggcttcctcgccggcgacaagctggcctgcgccatcgtcaacacggccggccgcgagacaggaggcgtgcactggctcgcctttggctggaacccgcgctcgcgcacctgctacatgttcgacccctttgggttctcggaccgccggctcaagcagatttacagcttcgagtacgaggccatgctgcgccgcagcgccctggcttcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggagctctaccgcttcctcgcgcgccactccccttactttcgatcccaccgcgccgccatcgaacacgccaccgcttttgacaaaatgaaacaactgcgtgtatgactcaaataaacagcacttttattttacacatgcactggagtatatgcaagttatttaaaagtcgaaggggttctcgcgctcatcgttgtgcgccgcgctggggagggctacgttgcggtactggtacttgggctgccacttgaactcggggatcaccagtttgggaacgggaatctcggggaaggtctcgctccacatgcgccggctcatctgcagggcgcccagcatgtccggggctgagatcttgaaatcgcagttggggccggtactctgcgcgcgcgagttgcggtacacggggttgcagcactggaacaccatcagactggggtacttcacgctggccagcacgctcttgtcgctgatctgatccttgtccaggtcctcggcgttgctcaggccgaacggggtcatcttgcacagctggcggcccaggaagggcacgctgtggggcttgtggttacactcgcagtgcacgggcatcagcatcatccccgcaccgcgctgcatattcgggtagagggccttgacgaaggccatgatctgcttgaaagcttgctgggccttggccccctcgctgaagaacaggccgcagctcttcccgctgaactggttattcccacatccggcatcctgcacgcagcagcgcgcgtcatggctggtcagttgaaccacgcttctcccccagcggttctgggtcaccttggccttgctgggctgttccttcaacgcgcgctgtccgttctcgctggtcacatccatttccaccacgtggtccttgtggatcattaccgtcccgtgcagacatttgagctggccttccacctcggtgcagccgtggtcccacaaggcgctgccggtgcactcccagttcttgtgcgcgatcccgctgtggctgaagatgtaaccttgcaacaggcggcccatgacggtgctaaagctcttctgggtggtgaaggtcagttgcagcccgcgggcctcctcgttcatccaggtctggcacatcttctggaagatctcggtctgctcgggcatgagcttgaaagcatcgcgcaggccgctgtcgacgcggtagcgttccatcagcacgttcatggcatccatgcccttctcccaggacgagaccagaggcagactcagggggttgcgcacgttcaggacaccgggggtcgcgggctccacgatgcgttttccgtccttgccttccttcaacagaaccggcggctggctgaatcccactcccacgatcacggcatcttcttcctggggcatctcttcgtcggggtctaccttggtcacatgtttggtcttcctggcttgcttctttggcagttttggagggctgtctacggggaccacgtcctcctcggaagacccggagcccacccgctggtactttcggcgcttggtgggcagaggaggtggcggcgaggggctcctctcctgctccggcggatagcgcgccgacccgtggccccggggcggagtggcctctcggtccatgaaccggcgcacgtcctgactgccgccggccattgtttcctaggggaagatggagccgcgtaagcaggagcaggaggaggacttaaccacccacgagcaacccaaaatcgagcaggacctgggcttggaagagccggctcgtctagaacccccacaggatgaacaggagcacgagcaagacgcaggccaggaggagaccgacgctgggctcgagcatggctacctgggaggaggagatgtgctgctgaaacacttgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctaccccgtcttcgcggtccccgaggccctcgtcacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaatgccaggctggccgtgctcaagcgcagcgtcgagctcacccatttcgcctaccccgccgtcaacctcccgcccaaggtcatgcgtcgcatcatggatcagctcatcatgccccacatcgaggccctcgatgaaagtcaggagcagcgccccgaggacgcccaaccggtggtcagcgacgagcagctcgcgcgctggctcgggacccgcgacccccaggccctggagcagcggcgcaagctcatgctggccgtggtcctggtcaccctcgagctggaatgcatgcgccgcttctttagcgaccccgagaccctgcgcaaggtcgaggagaccctgcactacactttcagacacggtttcgtcaggcaggcctgcaagatctccaacgtggagctgaccaacctggtctcctgcctggggatcctgcacgagaaccgcctggggcagaccgtgctccactcgaccctgaagggcgaggcgcggagggactacgtccgcgactgcgtctttctctttctctgccacacctggcaagcggccatgggcgtgtggcagcagtgtctcgaggacgagaacctgaaggagctggacaagcttcttgctagaaacctcaaaaagctgtggacgggcttcgacgagcggaccaccgctgccgacctggccgagatcgttttccccgagcgcctgaggcagacgctgaaaggcggcctgcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaggactaccacgcccacgagataaagttcttcgaggaccaatcgcgcccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagccgctagtggaggaggagatggaagaagaatgggacagccaggcagaggaggaagaatgggaggaggagagtacagaggaggaagaattggaagaggtggaagaggagcaggcaacagagcagcccgtcgccgcaccatccgcgccggcagccccggcggtcacggatacaacctccgcagcgcctccggtcaagcctcctcgtagatgggatcgagtgaagggtgacggtaagcacgagcggcagggctaccgatcatggagagcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagccagtaagaggagtcgccggaggaggaggcctgaggatcgcggcgaacgagccctcgaccaccagggagctgaggaaccggatcttccccactctttatgccatttttcagcagagtcgaggtcagcagcaagagctcaaagtaaaaaatcggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgcaaccaccatgagcaaggagattcccacaccttacatgtggagctatcagccccagatgggcctggccgcgggcgcctcccaagactactccacccgcatgaactggctcagtgccgggccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaaatagccggagccgggagatcctccttcactcccaaccaggcctacctgaccttgcagagcagctcttcggagcctcgctccggaggcatcggaaccctccagttcgtggaggagtttgtgccctcggtctacttcaaccccttctcgggctcgccaggcctctacccggacgagttcatcccgaacttcgacgcagtaagagaagcggtggacggctacgactgaatgtcctatggtgactcggctgagctcgctcggttgaggcatctggaccactgccgccgcctgcgctgcttcgcccgggagagctgcggcctcatctactttgagctgcccgaggagcaccccaacggccctgcacacggagtgcggatcaccgtagagggcaccaccgagtctcacctggtcaggttcttcagccagcaacccttcctggtcgagcgggaccggggcgccaccacctacaccgtctactgcatctgtcctaccccgaagttgcatgagaatttttgctgtactctttgtggtgagtttaataaaagctaaactcttacaatactctggaccttgtcgtcgtcaactcaacgagaccgtctacctcaccaaccagactgaggtaaaactcaactgcagaccagggggcaaatatatcatctggctctttgagaacacttccttcgcagtctccaacacccactgcaacgacggtattgaaatacccaacaaccttaccagtggactaacttacaccaccagaaagactaagctagtactctacaatccttttgtagagggaacctaccactgcaagagcggatcttgctaccacactttcactttggtgaacgttaccggcagcagcacagccgctcctgaaacaactaacctttcttctgatactaacaaacctcgtgtcggaggtgagctttgggttccctctctaacagagggtgggagtcatattgaagtggtcgggtatttgattttaggggtggtcctgggtgggtgcatagcggtgctatatcaccttccttgctgggtcgaaatcagggtctttatctgctgggtcagacattgtggggaggaaccatgaaggggctcttgctgattatcctttccctggtggggggtttactggcctgccacgaacagccacgatgtaacattaccacaggcaatgagaggagtgtgatatgtacagtaatcataagatgcgagcatgaatgtcctctcaacatcacattcaagaataagaccatgggaaatgtatgggtgggtgattgggaaccaggagatgagcagaactacacggtcactgtccatggtagcgatggaaaacacactttcggtttcaaattcatttttgaagtcatgtgtgatatcacactgcatgtggctagacttcatggcttgtggccccctaccaaggagaacatggttgggttttctttggcttttgtgatcatggcctgcttgatgtcaggtctgctggtaggggctctagtgtggttcctgaagcgcaagcccaggtacggaaatgaggagaaggaaaaattgctataaatctttttctttttcgcagaaccatgaatactttgaccagtgtcgtgctgctctctcttcttgtggtttttagtcagggacaaatagaacatgaaaaacagagtgttcagtggggaaagaacataacgcttgtgggtcctaacgataagcctgttgaatggcatgggcctagagatcagctttgtaagggaaaacaaatttttcacccagaattcaatcacacatgtaatgaacaaaacctcacactgctgtttgtgaacaacactttccagggaaaatattatggctttagaaatgatggtaaaggtatgaaacaaattgaactaacagtagtcccacctcctgcctcaacacgcaaacctttgtcaaagccaaaacaagtcaatgtccaatatggacataatgtaacattagaaggtcctccaggaatacctattgactggcttggaccaactaatcagctttgtaaaggaaaacaaattttacatccagaaataaaccacacctgcaatgttcaaaatctaacactgctatttgtaaactacactcatcgcggagcgtattttggctttaacaaagacggaactgataggcaacactatgaagttactattctagatggcttcagagatgcagggcagacaaaagatgagacagacagtcataaaacaaaaggaaaaacttcttcaaaacagaaaaaaacacaaaaaaataactctcatagaaatgatgatgttaaagagttagattttccaagtggatctaatcaaactttaattggtcctcctggttcaaaagttgattggtacacaacaaaaaatggtgactttacaaaattgtgcgatggattgaacggtccaaagaatctgtgtaattatcagaacttgacattgcgaaatgtaagcagacaggatgaaggaacttattttgggtctaatgaacagtcaaagcattacagagttactgtctatacaaaacctagaaatcaaactaaaagaattcagccatatactactaagggaactaccaaaggaactacaaaattaacctcaggtaatcacagctttgaattgcaactggcagatgatcaatctaatcaacaggatcaacaaattccatcaactaccgtggcaatcgtggtgggtgtgattgcgggcttcataactctgatcattgtcattctgtgctacatctgctgccgcaagcgtcccagggcttacaataatatggtagacccactactcagcttctcttactgagactcagtaactttcatttcagaaccatgaaggctttaacagcttttggtctgatcttaatcacactaagctacactgctgcagctgcttgctattataatcttaatgtaaccagaggagaaaatattacactctcaggagcaggaattaatactacatggacagcttatcataatagtggaaatggaggaaaacatggatggttgccaatctgcacatggggcgatgggcgctatctgtgcaatggcaacagcagtactatttctaatcttacatttgtagcaagcagaaattcttctgacagaaattttaaggcagagagttatactaataatgatgattatgaagttgtaaaatcatgttattataatgttaaaatcattgagcttccaaccactagagcacccaccacagttaggtcaactacacagtcctctactaaagagacaacacagcctaccactgtgcccactacacaaccaaccaccacagccagtacaactattgagaccactactcacactacacacctagacacaacagtacagaatagtactgtgttggttaggtttttgttgagggaggaaagtactactgaacagacagaggctacctcaagtgccttcagcagcactgcaaatttaacttcgcttgcttcaataaatgagaccctcgtgccgttgatgctggaacaagatctaagaggtttggatatgcaaattacttttctggttgtatgtgggatctttattcttgtggttcttctgtactttgtctgctgtaaagccagagagaaatctaggcggcccatctacaggccagtaatcggggaacctcagccgctgcaagtggaagggggtctaaggaatcttctcttctctttttcagtatggtgatcagccatgattcctaggttcttcctatttaacatcctcttctgtctcttcaacatctgcgctgcctttgcggccgtctcgcacgcctcgcccgactgtctcgggcccttccccacctacctcctctttgccctgctcacctgcacctgcgtctgcagcattgtctgtctggtcgtcaccttcctgcagctcatcgactggtgctgcgcgcgctacaattacctacaccacagtcccgaatacagggacgagaacgtagccagaatcttaaggctcatatgaccatgcagactctgctcatactgctatccctgctcctatcccctgccctcgctgatgatgattactctaagtgcaaatttgtgaagctatggaatttcttagactgctatgatgctaaaatggatatgccatcctattacttggtgattgtggggatagtcatggtctgctcctgcactttctttgccatcatgatctacccctgttttgatctcggctggaactctgttgaggcattcacatacacactagaaagcagttcactagcctccacgccaccacccacacctcctccccgcagaaatcagtttcccctgattcagtacttagaagagccccctccccgacccccttccactgttagctactttcacataactggcggcgatgactgaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcatcaaccccatagtcatcacccagcagtcgggcgaggccagcggctgcatccactgctcctgcgaaagccccgagtgcatctactccctactcaagaccctttgcggactccgcgaccttctccccatgaactgatgttgattaaagcccagaaaccaatcaaaccccttcccctttgccccaaataaacaatcattggaaataatcattcaataaagatcacttacttgaaatctgaaagtatgtctctggtgtagttgttcagcagcacctcggtaccctcctcccagctctgatactccagtccccggcgggcggcgaacttcctccacaccttgaaagggatgtcaaattcctggtccacaattttcattgtcttccctctcagatggcaaagaggctccgggtggaagatgacttcaaccccgtctacccctatgactacgcgcggaatcagaatatccccttcctcactcccccctttgtctcctccgatggattcaaaaacttcccccctggggtcctgtcactcaaactggctgacccaatcaccatagccaatggtgatgtctcactcaaggtgggagggggacttactttgcaagaaggaagtctgactgtagaccctaaggctcccttgcaacttgcaaatgataaaaaacttgagcttgtttatgatgatccatttgaggttagcaccaataaacttagtttaaaagtaggacatggattaaaagtattagatgacaaaagtgctggagggttgaaagatttaattggcaaacttgtggttttaacaggaaaaggaataggtattgaaaatttgcaaaacgacgatggtagtagcagaggggttggtataaatgtaagactcggcacagatggaggtctgtcctttgacaggaaaggtgaattagtagcttggaacagaaaagatgacaggcgaaccctttggacaacacctgatccatcgcccaattgtaaagccgaaacagaaaaggactcaaagcttactttggttctaacaaaatgcggaagtcaaatcttagctactgtgtctattattgttcttaagggtaaatatgaatttgttaaaaaagaaacagagcctaagtcctttgatgttaaattgctgtttgacagcaaaggagtgcttctaccaacttcaaatctttccaaagaatattggaactatagaagttatgataacaacataggaactccttatgaaaatgcagttccatttatgccaaatctaaaagcttatccaaaaccaactaaaactgcttcagataaagcagaaaataaaataagcagtgctaaaaacaaaattgtaagcaacttctactttggagggcaagcatatcaacctgggacaataataattaagtttaatgaggaaatagatgagacatgtgcatactctatcacctttaactttggttggggcaaggtatatgacaatccatttccatttgataccacctcttttaccttctcttatattgcccaagaaaatgaagacaaagactaataaaatgttttgaactggatttatgaatctttattgatttttacaccagcacgggtagtcagtctcccaccaccagcccatttcacagtgtacacgattctttcagcacgggtggccttaaataggggaatattattattggaacgggaactagatttagtgtctataatccacacagtttcctggcgagccaaacgggggtcggtgattgagatgaagccgtcctctgagaagtcatccaagcgggcctcacagtccaaggtcacagtctggtggaacgagaagaacgcacagattcatactcggaaaacaggatgggtctgtgcctctccatcagcgccctcaacagtctttgccgccggggctcggtgcgactgctgcagatgggatcgggatcacaagtctctctgactatgatccccacagccttcagcatcagtctcctggtgcgtcgggcacagcaccgcatcctgatctctgccatgttctcacagtaagtgcagcacataatcaccatgttatttagcagcccataattcagggtgctccagccaaagctcatgttggggatgatggaacccacgtgaccatcgtaccagatgcggcagtatatcaggtgcctgcccctcataaacacactgcccatatacatgatctctttgggcatgtctctgttcacaatctgacggtaccatgggaaacgctggttgaacatgcacccgtaaatgactctcctgaaccacacggccagcagggtgcctcccgcccgacactgcagggagcccggggatgaacagtggcaatgcaggatccagcgctcgtacccgctcaccatctgagctctcaccaagtccagggtagcggggcacaggcacactgacatacatctttttaaaatttttatttcctctggggtcaggatcatatcccatgggactggaaactcttggagcagggtaaagccagcagcacatggtaatccacggacagaacttacattatgataatctgcatgatcacaatcgggcaacaggggatgttgttcagtcagtgaagccctggtctcctcatcagatcgtggtaaacgggccctgcgatatggatgatggcgcagcgagctggattgaatctcggtttgcattgtagtggattctcttgcgtaccttgtcgtacttctgccagcagaaatgggcccttgaacagcagatacccctcctgcggccgtcctttcgctgctgccgctcagtcatccaactgaagtacatccattctcgaagattctggagaagttcctctgcatctgatgaaacaaaaaacccgtccatgcgaattcccctcatcacatcagccaggactctgtaggccatccccatccagttaatgctgccttgtctatcattcagagggggcggtggcaggattggaagaaccatttttattccaagcggtctcgaaggacgataaagtgcaaatcacgcaggtgacagcgttccccgccgctgtgctggtggaaacagacagccagatcaaaacccactctattttcaaggtgctcgaccgtggcttcgagcagtggctctacgcgtacatccagcataagaatcacattaaaggccggccctccatcgatttcatcaatcatcaggttacactcgttcaccatccccaggtaattctcatttttccagccttgaattatctctacaaattgttggtgtaagtccactccgcacatgtggaaaagctcccacagcgccccctccactttcataatcaggcagaccttcatattagaaacagatcctgctgctccaccacctgcagcgtgttcaaaatagcaagatttaatgaggttctgccctctgccctcagctcgcgcctcagcgtcagctgtaaaaagtcactcaagtcctcagacaccacagctgccaactctgagcctgggctaagcgtgggactggcaagcgtgagggaatatttcagtgctccataattagcccccaaaaactgcatgctggaataagctctctttgtgtctccggtgatgccttccaataggtgagtaataaagcgaggtagctcttttctaatcattgcagtaatggaaaagtcctctaaatagttgactaaaacaccaggtaccacaatgtggtagctgacaccgtggcgctcaagcatggttagtagagatgaaagtctgaaaaacagaaatcatgcactaaaccagagtggccagtctcactgaaggaaaaatcactctctgaagcaacagtgtgcccactgggtggccctcgcggacatacaaaaatcggtccgtgtggttaaagagcagcacagctagctcctgtcttctcccggcaaaaatcacatcggactgggttagtatgccgctggtatggtagtcattcaaggccataaatctgccttggtagccattaggaatcagcacgctcactctcaggtgaagcaaaaccaccccatgcggaggaatgtggaaagattctgggcaaaagaaggtatatctattgctagtcccttcctggacgggagcgatccctccaggactatctatgaaagcatacagagattcagccatagctcagcccgcttaccagtagacagagagcacagcagtacaagcgccaacagcagcgactgactacccactaacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtatggcgccatattgcccacgtccaaaatggcttccatgtccagccacgcctccgcgacgaccgtcggccgtgcgtcgtgacgtcatttgcatcaccgcttctcgttcaatgagcgttggctccgcccaaaaaccgttaagattcaaaagctcatttgcatattaacttttgtttactttgtggggtatattattgatgatg

SEQ ID NO: 22 - DNA, 35717 bp, Adenovirus D17
  MISC_FEATURE (1)..(35717): Complete Genome
catcatcaataatataccccacaaagtaaacaaaagttaatatgcaaatgaggttttaaatttagggcggggctactgctgattggccgagaaacgttgatgcaaatgacgtcacgacgcacggctaacggtcgccgcggaggcgtggcctagcccggaagcaagtcgcggggctgatgacgtataaaaaagcggactttaaacccggaaacggccgattttcccgcggccacgcccggatatgaggtaattctgggcggatgcaagtgaaattaggtcattttggcgcgaaaactgaatgaggaagtgaaaagtgaaaaataccggtcccgcccagggcggaatatttaccgagggccgagagactttgaccgattacgtgtgggtttcgattgcggtgttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtgtgagaaaaatgagacacctgcgcctcctgcctggaactgtgcccttggacatggccgcattattgctggatgactttgtgagtacagtattggaggatgaactgcaaccaactccgttcgagctgggacccacacttcaggacctctatgatttggaggtagatgcccaggaggacgacccgaacgaagatgctgtgaatttaatatttccagaatctctgattcttcaggctgacatagccagcgaagctctacctactccacttcatactccaactctgtcacccatacctgaattggaagaggaggacgagttagacctccggtgttatgaggaaggttttcctcccagcgattcagaggacgaacagggtgagcagagcatggctctaatctcagactatgcttgtgtggttgtggaagagcattttgtgttggacaatcctgaggtgcccgggcaaggctgtaaatcctgccagtaccaccgggataagaccggagacacgaacgcctcctgtgctctgtgttacatgaaaaagaacttcagctttatttacagtaagtggagtgaatgtgagagaggctgagtgcttaagacataactgggtgatgcttcaacagctgtgctaagtgtggtttattttgtttctaggtccggtgtcagaggatgagtcatcaccctcagaagaagaccacccgtgtccccctgagctgtcaggcgaaacgcccctgcaagtgcacagacccaccccagtcagacccagtggcgagaggcgagcagctgttgaaaaaattgaggacttgttacatgacatgggtggggatgaacctttggacctgagcttgaaacgtcccaggaactaggcgcagctgcgcttagtcatgtgtaaataaagttgtacaataaaaattatatgtgacgcatgcaaggtgtggtttatgactcatgggcggggcttagttctatataagtggcaacacctgggcactggagcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaaaaaggattataacgaggaatttgaaaatctttttgctgattgctctggcctgctagattctctgaatctcggccaccagtcccttttccaggaaagggtactccacagccttgatttttccagcccagggcgcactacagccggggttgcttttgtggtttttctggttgacaaatggagccagaacacccaactgagcaggggctacattctggacttcgcagccatgcacctgtggagggcatgggtcaggcagcggggacagagaatcttgaactactggcttctacagccagcagctccgggtcttcttcgtctacacagacaaacatccatgttggaggaagaaatgaggcaggccatggacgagaacccgaggagcggtctggaccctccgtcggaagaggagttggattgaatcaggtatccagcctgtacccagagcttagcaaggtgctgacatccatggccaggggagtgaagagggagaggagcgatgggggcaataccgggatgatgaccgagctgacggccagtctgatgaatcgcaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcattgataccctggacaaggccgcctttaggtgttgcatgatgggaatgagagccggagtgatgaatatgaattccatgatctttatgaacatgaagttcaatggagagaagtttaatggggtgctgttcatggccaacagccacatgaccctgcatggctgcgactttttcggctttaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgaggcactgctcttccctggagacgggctgcttctgcctggtgaagggcacagcctctctgaagcataatatggtgaagggctgcacggatgagcgcatgtacaacatgctgacctgcgactcgggggtctgtcatatcctgaagaacatccatgtgacctcccaccccagaaagaagtggccagtgtttgagaataacatgctgatcaagtgccacatgcacctgggcgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaaggtgactataaaggcgggtgtcttacgagggtctttttgcttttctgcagacatcatgaacgggaccggcggggccttcgaaggggggctttttagcccttatttgacaacccgcctgccaggatgggccggagttcgtcagaatgtgatgggatcgacggtggacgggcgcccagtgcttccagcaaattcctcgaccatgacctacgcgaccgtggggaactcgtcgcttgacagcaccgccgcagccgcggcagccgcagccgccatgacagcgacgagactggcctcgagctacatgcccagcagcagcagtagcccctctgtgcccagttccatcatcgccgaggagaaactgctggccctgctggccgagctggaagccctgagccgccagctggccgccctgacccagcaggtgtccgagctccgcgaacagcagcagcaaaataaatgattcaataaacacatattctgattcaaacagcaaagcatctttattatttattttttcgcgcgcggtaggccctggtccacctctcccgatcattgagagtgcggtggattttttccaagacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaagcggttgagctgggagggatgcatgcggggggagatgatgtgcagtttggcctggatcttgaggttggcgatgttgccacccagatcccgccgggggttcatgttgtgcaggaccaccaggacggtgtagcccgtgcacttggggaacttatcatgcaacttggaagggaatgcgtggaagaatttggagacgcccttgtgcccgcccaggttttccatgcactcatccatgatgatggcgatgggcccgtgggctgcggctttggcaaagacgtttctggggtcagagacatcataattatgctcctgggtgagatcatcataagacattttaatgaattttgggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctaacttggaggttttcccggacgagctcgccgaggaggcggtccccgcccagcgagaggagctcttgcagggaagcaaagtttttcaggggcttgagtccgtcggccatgggcatcttggcgagggtctgcgagaggagttcgagacggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggcccctggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgtccgcaggcgggacagaggagggattgcagggcgtagagcttgggcgcaagaaagaccgactcgggagcaaaagcgtccgctccgcagtgggcgcagacggtctcgcactcgacgagccaggtgagctcgggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccaggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcaatgctttttaggagactttcatccatctggtcagaaaagactatttttttattgtcaagcttggtggcaaaggagccatagagggcgttggagagaagcttggcgatggatctcatggtctgatttttgtcacggtcggcgcgctccttggccgcgatgttgagctggacatattcgcgcgcgacacacttccattcgggaaagacggtggtgcgctcgtcgggcacgatcctgacgcgccagccgcggttatgcagggtgaccaggtccacgctggtggccacctcgccgcgcaggggctcgttagtccagcagagtctgccgcccttgcgcgagcagaacgggggcagcacatcaagcagatgctcgtcaggggggtccgcatcgatggtgaagatgccgggacagagtttcttgtcaaaatagtctatttttgaggatgcatcatccaaggccatctgccactcgcgggcggccattgctcgctcgtaggggttgaggggcggaccccagggcatgggatgcgtgagggcggaggcgtacatgccgcaaatgtcgtagacatagatgggctccgagaggatgccgatgtaggtgggataacagcgccccccgcggatgctggcgcgcacgtagtcatacaactcgtgcgagggggccaagaaggcggggccgagattggtgcgctggggctgctcggcgcggaagacaatctggcgaaagatggcgtgcgagttggaggagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttcgcggatgatgtcataacccgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgtgcggccttgcggagcgaggtgtgcgtcagggcgaaggtgtccctgaccatgactttcaagaactggtacttgaaatccgagtcgtcgcagccgccgtgctcccatagctcgaaatcggtgcgcttcttcgagagggggttaggcagagcgaaagtgacgtcattgaagagaatcttgcctgctcgcggcatgaaattgcgggtgatgcggaaagggcccgggacggaggctcggttgttgatgacctgggcggcgaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccattcctggagatgtgggttggcttgcatgaaggaagcccagagctcgcgggccatgagggtctggagctcgtcgcgaaagaggcggaactgctggcccacggccatcttttcgggtgtgacgcagtagaaggtgagggggtcccgctcccagcgatcccagcgtaagcgcgcggctagatcgcgagcaagggcgaccagctctgggtcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgttgcgccctgagagcgctggcgtgcgcgacgacgcggcggttgacatcctggatctgccgcctctgcgtgaagaccactggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcgacccgcgcgctccacggtggcggcgaggtcattcgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcgttgcgggccgagaccgtgagctcgtcttccaggagcctgatgagctcggcgatggtggcgcgcacctcgcgctcgaaatccccgggggcctcgtcctcttcctcttcttccatgacaacctcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctaatgatgtaattgaagtaggcgtttttgaggcggcggatggtggcgaggaggaccaggtccttgggtcccgcttgctggatgcggagccgctcggccatgccccaggcctggccctgacaccggcttaggttcttgtagtagtcatgcatgagcctctcgatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaagtgcagttggccatgagcgaccagttgacggtctgcaggccgggctgcacgacctcggagtacctgagccgcgagaaggcgcgcgagtcgaagacgtagtcgttgcaggtgcgcacaaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcagcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgcgtgtaccccggttcgagtcccctcgaatcaggctggagccgcgactaacgtggtattggcactcccgtctcgacccgagcccgatagccgccaggatacggcggagagccctttttgccggccgaggggagtcgctagacttgaaagcggccgaaaaccccgccgggtagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccttccccggagcgacacccccgcgtgcagctgcagaaggacgtgcgcccggcgtacgtgcctgcgcaaaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccatgtgcgcaccctgatcgcgcgcgaggaggtggccctgggcctgatgcacctgtgggacctggcggaggccatcgtgcagaacccggacagcaagcctctgacggcgcagctgttcctggtggtacagcacagcagggacaacgaggcgttcagggaggcgctgctaaacatcgccgagcccgagggtcgctggctgctggagctgatcaacatcttgcagagcatcgtagttcaggagcgcagcctgagcttggccgagaaggtggcggcaatcaactactcggtgcttagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcgcgagccggcggcgcgagctgagcgaccgcgagctgatgctgagcctgcgccgggcgctggtagggggcgccgccggcggcgaggagtcctacttcgacatgggggcggacctgcattggcagccgagccggcgcgccttggaggccgcctacggtccagaggacttggatgaggaagaggaagaggaggaggatgcacccgctgcggggtactgacgcctccgtgatgtgtttttagatgcagcaagccccggaccccgccataagggcggcgctgcaaagccagccgtccggtctagcatcggacgactgggaggctgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctagtgtacaacgccctgctggagcgcgtaggccgctacaacagcacaaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggatgattacaccaactttatcagcgcgctgcggctgatggtgaccgaggtgccccagagcgaggtgtaccagtcgggcccggactactttttccaaactagcagacagggcctgcaaacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagtggcagcgtaaaccgcaactcgtacctgggtcacctgctaacgctgtaccgcgaggccataggccaggcgcaggtggacgagcagaccttccaggagatcactagcgtgagccgcgcgctggggcagaacgacaccgacagtctgagggccaccctgaacttcttgctgaccaatagacagcagaagatcccggcgcagtacgcgctgtcggccgaggaggagcgcatcctgagatatgtgcagcagagcgtagggcttttcctgatgcaggagggggccactcccagcgccgcgctggacatgaccgcgcgcaacatggaacctagcatgtacgccgccaaccggccgtttatcaataagctaatggactacctgcatcgcgcggcgtccatgaactcggactactttaccaatgccattttgaacccgcactggcttccgccgccggggttctatacgggcgagtacgacatgcccgaccccaacgacgggtttttgtgggacgacgtggacagcgcggtgttttcaccgaccttgcaaaagcgccaggaggcggtgcgcacgcccgcgagcgagggcgcggtgggtcggagcccctttcctagcttagggagtttgcatagcttgccgggctctgtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggagcctgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgttgtacgacaccactcgcgtgtacttggtggacaacaagtcggcggacatcgcttccctgaactatcaaaacgaccacagcaacttcctgaccacggtggtgcagaacaacgatttcacccccgccgaggctagcacgcagacgataaattttgacgagcggtcgcggtggggcggtgatctgaagaccattctgcacaccaacatgcccaatgtgaacgagtacatgttcaccagcaagtttaaggcgcgggtgatggtggctagaaaacacccacagggggtagaagcaacagatttaagcaaggatatcttagagtatgagtggtttgagtttaccctgcccgagggcaacttttccgagaccatgaccatagacctgatgaacaacgccatcttggaaaactacttgcaagtggggcggcaaaatggcgtgctggagagcgatattggagtcaagtttgacagcagaaatttcaagctgggctgggaccctgtgaccaagctggtgatgccaggggtctacacctacgaggcctttcacccggacgtggtgctgctgccgggctgcggggtggacttcacagagagccgcctgagcaacctcctgggcattcgcaagaagcaacctttccaagagggcttcagaatcatgtatgaggatctagaagggggcaacatccccgccctgctggatgtgcccaagtacttggaaagcaagaagaagttagaggaggcattggagaatgctgctaaagctaatggtcctgcaagaggagacagtagcgtctcaagagaggttgaaaaggcagctgaaaaagaacttgttattgagcccatcaagcaagatgatagcaagagaagttacaacctcatcgagggaaccatggacacgctgtaccgcagctggtacctgtcctatacctacggggaccctgagaagggggtgcagtcgtggacgctgctcaccaccccggacgtcacctgcggcgcggagcaagtctactggtcgctgccggacctcatgcaagaccccgtcaccttccgttctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgtccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgtgtgctttccagtcgcaccttctaaaaaatgtctattctcatctcgcccagcaataacaccggctggggtattactaggcccagcagcatgtacggaggagccaagaaacgctcccagcagcaccccgtccgcgtccgcggccacttccgcgctccctggggcgcttacaagcgcgggcggactgccaccgccgccgccgtgcgcaccaccgtcgacgacgtcatcgactcggtggtcgccgacgcgcgcaactatactcccgccccctcgaccgtggacgcggtcattgacagcgtggtggccgacgcgcgcgactatgccagacgcaagagccggcggcgacggatcgccaggcgccatcggagcacgcccgccatgcgcgccgcccgagctctgctgcgccgcgccagacgcacgggccgccgggccatgatgcgagccgcgcgccgcgccgccactgcaccccccgcaggcaggactcgcagacgagcggccgccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcagagcgggcgggcgagtttgcctacgggaagcggtcgcgcgaagaggagctgatctcgctgccgctggacgagagcaatcccacgccgagcctgaagcccgtgaccctgcagcaggtgctgccccaggcggtgctgctgccgagccgcgggatcaagcgcgagggcgagaacatgtacccgaccatgcagatcatggtgcccaagcgccggcgcgtggaggaagtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacgacccctggctcccagcctccaccgctaccgcttccacttctaccgtcgccacggtcaccgagcctcccaggaggcgaagatggggccccgccaaccggctgatgcccaactacgtgttgcatccttccattatcccgacgccgggctaccgcggcacccggtactacgccagccgcaggcgcccagccagcaaacgccgccgccgcaccgccacccgccgccgtctgccccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgttccgaattaccgaggaagatcccgccgcaggagaggcatggcaggcagcggcctgaaccgccgccggcggcgggccatgcgcaggcgcctgagtggcggctttctgcccgcgctcatccccataatcgcggcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacggcctggcctcgggcattaacggggtggtggacatcgcgaaccaggcagtgcagcgcgagataaacagccgtctggacccgcggccgcccacggtggtggagatggaagatgcaactcttccgccgccgaagggcgagaagcggccgcggccagatgcggaggagacgatcctgcaggtggacgagccgccctcgtacgaggaggccgtgaaggccggcatgcccaccacgcgcatcatcgcgccactggccacgggtgtaatgaaacccgccacccttgacctgcctccaccacccacgcccgctccaccgaaggcagctccggttgtgcagccccctccggtggcgaccgccgtgcgccgcgtccccgcccgccgccaggcccagaactggcagagcacgctgcacagtattgtgggcctgggagtgaaaagtctgaagcgccgccgatgctattgagagagaggaaggaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacgtactttgacatccgcggcgtcctggaccgcggtcccagtttcaaaccctactcgggcacggcttacaacagccttgcccccaagggcgctcccaatcccagtcagtgggttgccaaagaaaatggtcagggaactgataagacacatacttatggctcagctgccatgggaggaagcaacatcaccattgaaggtttagtaattggaactgatgaaaaagctgaggatggcaaaaaagatatttttgcaaataaactttatcagccagaacctcaagtaggtgaagaaaactggcaagagtctgaagccttctatggaggcagagctcttaagaaagacacaaaaatgaagccctgctatggctcatttgcaagacctaccaatgaaaaaggcggacaagctaaatttaagccagtggaagaggggcagcaacctaaagattatgacatagatttggctttctttgacacacctggaggcaccatcacaggaggcacagacgaagaatataaagcagacattgtgttgtacactgaaaatgtcaaccttgaaaccccagacacccacgtggtatacaagccaggaaaagaggatgacagttcagaagtaaatttgacacagcagtccatgcccaacaggcctaactacattggcttcagagacaactttgtgggactcatgtactacaacagtactggcaacatgggtgtgctggctggtcaggcctctcaattgaatgctgtggtcgacttgcaagacagaaacaccgagctgtcttaccagctcttgctagattctctgggtgacagaaccagatacttcagcatgtggaactctgcggtggatagctatgatccagatgtcaggatcattgaaaatcatggtgtggaagatgaacttccaaactattgcttcccattgaatggcactggcaccaattcaacatatcttggcgtaaaggtgaaaccagatcaagatggtgatgttgaaagcgagtgggataaagatgataccattgcaaggcagaatcaaatcgccaagggcaacgtctttgccatggagatcaacctccaggccaacctgtggaagagttttctgtactcgaacgtggccttgtacctgcccgactcctacaagtacacgccggccaatgttacgctgcccgccaacaccaacacctacgagtacatgaacggccgcgtggtagccccctcgctggtggacgcctacatcaacataggcgcccgatggtcgctggaccccatggacaacgtcaaccccttcaaccaccaccgcaatgcgggcctgcgctaccgctccatgcttctgggcaacggccgctacgtgcccttccacatccaagtgccccaaaagttctttgccatcaagaacctgctcctgctcccgggctcctacacctacgagtggaacttccgcaaggatgtcaacatgatcctgcagagttccctcggcaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgcttttcgcggctggagtttcacccgtctgaaaaccaaggaaactccctccctcggctcgggttttgacccctactttgtctactcgggctcgatcccctaccttgacgggaccttttaccttaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcacccaccatgcgccaagggcagccctaccccgccaacttcccctacccgctcatcggccagacagccgtgccatccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggaaacgccaccacctaagcatgagcggctccagcgaaagagagctcgcgtccatcgtgcgcgacctgggctgcgggccctactttttgggcacccacgacaagcgattcccgggctttcttgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgaagcgccctggcctcctcgcccgaccgctgtctcagcctcgaacagtccacccagaccgtgcaggggcccgactccgccgcctgcggacttttctgttgcatgttcttgcatgccttcgtgcactggcccgaccgacccatggacgggaaccccaccatgaacttgctgacgggggtgcccaacggcatgctacaatcgccacaggtgctgcccaccctcaggcgcaaccaggaggagctctatcgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcatcgttgtgcgccgcgctggggagggccacgttgcggtactggtacttgggctgccacttgaactcggggatcaccagtttgggcactggggtctcggggaaggtctcgctccacatacgccggctcatctgcagggcgcccagcatgtccggggcggatatcttgaaatcgcagttgggaccggtgctctgcgcgcgcgagttgcggtacacggggttgcagcactggaacaccatcagactggggtactttacgctggccagcacgctcttgtcgctgatctgatccttgtccagatcctcggcgttgctcaggccgaatggggtcatcttgcacagttggcgacccaggaatggcacgctctgaggcttgtggttacactcgcagtgcacgggcatcagcatcatccccgcgccgcgctgcatattcgggtagagggccttgacaaaggccgtgatctgcttgaaagcttgttgggccttggccccctcgctgaaaaacaggccgcagctcttcccgctgaactggttattcccgcacccggcatcctgcacgcagcagcgcgcgtcatggctggtcagttgcaccacgcttcttccccagcggttctgggtcaccttggctttgctgggttgctccttcaacgcgcgctgcccgttctcgctggtcacatccatctccaccacgtggtccttgtggatcatcaccgttccatgcagacacttgagctggccttccacctcggtgcagccgtgatcccacagggcactgccggtgcactcccagttcttgtgcgcgatcccgctgtggctgaagatgtaaccttgcaagaggcgacccatgatggtgctaaagctcttctgggtggtgaaggttagttgcagaccgcgggcctcctcgttcatccaggtctggcacatcttttggaagatctcggtctgctcgggcatgagcttgtaagcatcgcgcaggccgctgtcgacgcggtaacgttccatcagcacgttcatggtatccatgcccttttcccaggacgagaccagaggcagactcagggggttgcgcacgttcaggacaccgggggtcgcgggctcgacgatacgttttccgtccttgccttccttcaacagaaccggaggctggctgaatcccactcccacaatcacggcatcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggcggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggcccttgccacctatcacatctttttcaagaaccaaaagatccccgtctcctgccgcgccaaccgcacccgcgccgacgcgctcctcgctctggggcccggcgcgcgcatacctgatattgcttccctggaagaggtgcccaaaatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgttgagctcacccacttcgcctaccccgccgtcaacctcccgcccaaggtcatgcgtcgcatcatggatcagctaatcatgccccacatcgaggccctcgatgaaagtcaggagcagcgccccgaggacacccggcccgtggtcagcgatgagcagcttgcgcgctggcttggtacccgcgacccccaggccctggagcagcggcgcaagctcatgctggccgtggtcctggtcaccctcgagctcgaatgcatgcgacgctttttcagcgaccccgagaccctgcgcaaggtcgaggagaccctgcactacacttttaggcacggtttcgtcaggcaggcatgcaagatctccaacgtggagctgaccaacctggtctcctgcctgggaatcctgcacgagaaccgcctggggcagacagtgctccactcgaccctgaagggcgaggcgcggcgggactatgtccgcgactgcgtctttctctttctctgccacacatggcaagctgccatgggcgtgtggcagcagtgtctcgaggacgagaacctgaaggagctggacaagcttcttgctagaaacctcaaaaagctgtggacgggctttgacgagcgcaccgtcgcctcggacctggccgagatcgtcctccccgagcgcctgaggcagacgctgaaaggcgggctgcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacatcgcctaccactcggatgttatcgaggacgtgagcggcgaggggctgctagagtgccactgccgctgcaacctgtgctctccgcaccgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgcccgcagcacgcggatctcacggcctgcgtcatcacccagggcgcgatcctcgcccaattgcacgccatccaaaaatcccgccaagagtttcttttgaaaaagggtagaggggtctatctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgcagctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctatctgctcttccatcgcggggtgaacatcccccgcaacgtgttgcattactaccgtcaccttcacagctaagaaaaaatcagaagtaagaggagtcgccggaggaggcctgaggatcgcggcgaacgagcccttgaccaccagggagctgaggaatcggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggctcagtgccggcccctcgatgatctcacgggtcaacggggtccgtaaccatcgaaaccagatattgttggagcaggcggcggtcacctcaacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatacgaggcagaggcacacagctcaacgacgagttggtgagctcttcaatcggtctgcgaccggacggagtgttccaactagccggagccgggagatcgtccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcttatggtgactcggctgagctcgctcggttgaggcacctagaccactgccgccgcctgcgctgcttcgcccgggagagctgcggacttatctactttgagtttcccgaggagcaccccaacggccctgcacacggagtgcggatcaccgtagagggcaccaccgagtctcacctggttaggttcttcacccagcaacccttcctggtcgagcgggaccggggaggcaccacctacaccgtctactgcatctgtccaaccccgaagttgcatgagaatttttgttgtactctgtgtgctgagtttaataaaagctaaactcctacaatactctgggatcccgtgtcgtcgcactcgcaacaagaccttcaacctcaccaaccagactgaggtaaaattcaactgcagaccgggggacaaatacatcctctggctttttaaaaacacttccttcgcagtctccaacgcctgcgccaacgacggtattgaaatacccaacaaccttaccagtggactaacttatactaccagaaagactaagctagtactctacaatccttttgtagagggaacctaccactgccagagcggaccttgcttccacactttcactttggtgaacgttaccgacagcagcacagccgctacagaaacatctaaccttctttttgatactaacactcctaaaaccggaggtgagctctgggttccctctctaacagaggggggtaaacatattgaagcggttgggtatttgattttaggggtggtcctgggtgggtgcatagcggtgctgtattaccttccttgctggatcgaaatcaaaatctttatctgctgggtcagacattgttgggaggaaccatgaaggggctcttgctgattatcctttccctggtggggggtgtactgtcatgccacgaacagccacgatgtaacatcaccacaggcaatgagaggagtgtgatatgcacagtagtcatcaaatgcgagcatacatgccctctcaacatcacattcaaaaaccgtaccatgggaaatgcatgggtgggcgactgggaaccaggagatgagcagaactacacggtcactgtccatggtagcaatggaaatcacacttttggtttcaaattcatttttgaagtcatgtgtgatatcacactgcatgtggctagacttcatggcttgtggccccctaccaaggataacatggttgggttttctttggcttttgtgatcatggcctgtgcaatgtcaggtctgctggtaggggctttagtgtggttcctaaagcgcaagcctaggtatggaaatgaggagaaggaaaaattgctataaatctttttctcttcgcagaaccatgaatacagtgatccgtatcgtgctgctctctcttcttgtaacttttagtcaggcaggatttcataccatcaatgctacatggtgggctaatataactttagtgggaccctcagatattccagtcacatggtatgatagcactggattgcaattttgtgatggaagtacagttaagaatccacagatcagacatagttgtaatgatcaaaacttaactctgattcatgtgaacaaaacccatgaaagaacatacatgggctataataagcagagtactcataaagaagactataaagtcacagttataccacctcctcctgttactgtaaagccacaaccagagccagaatatgtgtatgttaatatgggagagaacaaaaccttagttgggcctccaggaattccagttagttggtttaatcaggatggtttacaattttgcattggggataaagtttttcatccagaattcaaccacacctgtgacatgcaaaatcttacactgttgtttataaatcttacacatgatggagcttatcttggttataatcgccagggaactgaaagaacttggtatgaggttgtagtgtcagatggttttccaaaatcagaagagatgaaggtagaagaccatagtaaagaaacagaacaaaaacagactggtcaaaaacaaagtgaccataagcagggtgggcaaaaagaaacaagtcaaaagaaaactaatgacaaacaaaagccatcgcgcaggaggccatctaaactaaagccaaacacacctgacacaaaactaattacagtcactagtgggtcaaacgtaactttagttggtccagatggaaaggtcacttggtatgatgatgatttaaaaagaccatgtgagcctgggtataagttagggtgtaagtgtgacaatcaaaacctaaccctaatcaatgtaactaaactttatgagggagtttactatggtactaatgacagaggcaacagcaaaagatacagagtaaaagtaaacactactaattctcaaagtgtgaaaattcagccgtacaccaggcctactactcctgatcagaaacacagatttgaattgcaaattgattctaatcaagacaaaattccatcaactactgtggcaatcgtggtgggagtgatcgcgggctttgtaactctaatcattattttcatatgctacatctgctgccgcaagcgtcccaggtcatacaatcatatggtagacccactactcagcttctcttactgaaactcagtcactctcatttcagaaccatgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatttgtgaatggaatgttactgcatacaaatgcttcaataatggaagcattactattactgccactgccaacattacttctggcacatacaaagctgaaagctataaaaatgaaattaaaaaattaacctataaaaacaacaaaaccacatttgaagattctggaaattatgagcatcaaaaattatctttttatatgttgacaataattgaactgcctacaaccaaggcacccaccacagttagtacaactacacagtcaactgttaagaccactactcacactacacagctagacaccacagtgcagaataatactgtgttggttaggtatttgttgagggaggaaagtactactgaacagacagaggctacctcaagtgcctttatcagcactgcaaatttaacttcgcttgcttggactaatgaaaccggagtatcattgatgcatggccagccttactcaggtttggatattcaaattacttttctggttgtctgtgggatctttattcttgtggttcttctgtactttgtctgctgtaaagccagaaagaaatctaggaggcccatctacaggccagtgattggggaacctcagccactccaagtggatggaggcttaaggaatcttcttttctcttttacagtatggtgatcagccatgattcctaggttcttcctatttaacatcctcttctgtctcttcaacatctgtgctgcctttgcggcagtttcgcacgcctcgcccgactgtctagggcctttccccacctacctcctctttgccctgctcacctgcacctgcgtctgcagcattgtctgcctggtcatcaccttcctgcagctcatcgactggtgctgcgcgcgctacaattaccttcatcatagtcccgaatacagggacgagaacgtagccagaattttaaggctcatatgaccatgcagactctgctcatactgctatcgctcttatcccatgccctcgctactgctgattactctaaatgcaaattggcggacatatggaatttcttagactgctatcaggagaaaattgatatgccctcctattacttggtgattgtgggaatagttatggtctgctcctgcactttctttgccatcatgatctacccctgttttgatcttggatggaactctgttgaggcattcacatacacactagaaagcagttcactagcctccacgccaccacccacaccgcctccccgcagaaatcagtttcccatgattcagtacttagaagagccccctccccgacccccttccactgttagctactttcacataaccggcggcgatgactgaccaccacctggacctcgagatggacggccaggcctccgagcagcgcatcctgcaactgcgcgtccgtcagcagcaggagcgtgccgccaaggagctcctcgatgccatcaacatccaccagtgcaagaagggcatcttctgcctggtcaaacaggcaaagatcacctacgagctcgtgtccaacggcaaacagcatcgcctcacctatgagatgccccagcagaagcagaagttcacctgcatggtgggcgtcaaccccatagtcatcacccagcagtcgggcgagaccaacggctgcatccactgctcctgcgaaagccccgagtgtatctactcccttctcaagaccctttgcggactccgcgacctcctccccatgaactgatgttgattaaaaaccaaaaaaaacaatcagccccttcccctatcccaaattactcgcaaaaataaatcattggaactaatcatttaataaagatcacttacttgaaatctgaaagtatgtctctggtgtagttgttcagcagcacctcggtaccctcctcccaactctggtactccagtctccggcgggcggcgaactttctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcccccctttgtctcctccgatggattcaaaaacttcccccctggggtcctgtcactcaaactggctgacccaatcaccatagccaatggtgatgtctcactcaaggtgggagggggacttactttgcaagaaggaagtctgactgtagaccctaaggctcccttgcaacttgcaaacaataaaaaacttgagcttgtttatgttgatccatttgaggttagtgccaataaacttagtttaaaagtaggacatggattaaaaatattagatgacaaaagtgctggagggttgaaagatttaattggcaaacttgtggttttaacagggaaaggaataggcactgaaaatttgcaaaatacagatggtagcagcagaggaattggtataagtgtaagagcaagagaagggttaacatttgacaatgatggatacttggtagcatggaacccaaagtatgacacgcgcacactttggacaacaccagacacatctcctaattgcaggattgataaggagaaggattcaaaactcactttggtacttacaaagtgtggaagtcaaatattagctaatgtgtctttgattgtggtgtcaggaaaatatcaatacatagaccacgctacaaatccaactcttaaatcatttaaaataaaacttctttttgataataaaggtgtacttctcccaagttcaaaccttgattccacatattggaactttagaagtgacaatttaactgtatctgaggcatataaaaatgcagttgaatttatgcctaatttggtagcctacccaaaacctaccactggctctaaaaaatatgcaagggatatagtctatgggaacatatatcttggaggtttggcatatcagccagttgtaattaaggttacttttaatgaagaagcagatagtgcttactctataacatttgaatttgtatggaataaagaatatgccagggttgaatttgaaaccacttcctttaccttctcctatattgcccaacaataaaagaccaataaacgtgttttttatttcaaattttatgtatctttattgatttttacaccagcgcgagtagtcaatctcccaccaccagcccatttcacagtgtacacggttctctcagcacgggtggccttaaatagggaaatgttctgattagtgcgggaactggacttggggtctataatccacacagtttcctggcgagccaaacggggatcggtgattgaaatgaagccgtcctctgaaaagtcatccaagcgggcctcacagtccaaggtcacagtctggtggaacgagaagaacgcacagattcatactcggaaaacaggatgggtctgtgcctctccatcagcgccctcagcagtctctgccgccggggctcggtgcggctgctgcagatgggatcgggatcacaagtctctctaactatgatcccaacagccttcagcatcagtctcctggtgcgtcgagcacagcaccgcatcctgatctctgccatgttctcacagtaagtgcagcacataatcaccatgttattcagcagcccataattcagggtgctccagccaaagctcatgttggggatgatggaacccacgtgaccatcgtaccagatgcggcagtatatcaggtgcctgcccctcatgaacacactgcccatatacatgatctctttgggcatgtttctgtttacaatctggcggtaccaggggaagcgctggttgaacatgcacccgtaaatgactctcctgaaccacacggccagcagggtgcctcccgcccgacactgcagggagccaggggatgaacagtggcaatgcaggatccagcgctcgtacccgctcaccatctgagctcttaccaagtccagggtagcggggcacaggcacactgacatacatctttttaaaatttttatttcctctgtggtgaggatcatatcccaggggactggaaactcttggagcagggtaaagccagcagcacatggtaatccacggacagaacttacattatgataatctgcatgatcacaatcgggcaacaggggatgttgatcagtcagtgaagccctggtttcatcatcagatcgtggtaaacgggccctgcgatatggatgatggcggagcgagctggattgaatctcggtttgcattgtagtggattctcttgcgtaccttgtcgtacttctgccagcagaaatgggcccttgaacagcatatacccctcctgcggccgtcctttcgctgctgccgctcagtcatccaactgaagtacatccattctcgaagattctggagaagttcctctgcatctgatgaaataaaaaacccgtccatgcgaattcccctcatcacatcagccaggactctgtaggccatccccatccagttaatgctgccttgtctatcattcagagggggcggtggcaggattggaagaaccatttttattccaaacggtctcgaaggacgataaagtgcaagtcacgcaggtgacagcgttcccctccgctgtgctggtggaaacagacagccaggtcaaaacccactctattttcaaggtgctcgaccgtggcttcgagcagtggctctacgcgtacatccagcataagaatcacattaaaggctggccctccatcgatttcatcaatcatcaggttacattcctgcaccatccccaggtaattctcatttttccagccttggattatctctacaaattgttggtgtaaatccactccgcacatgttgaaaagctcccacagtgccccctccactttcataatcaggcagaccttcataatagaaacagatcctgctgctccaccacctgcagcgtgttcaaaacaacaagattcaataaggttctgccctccgccctgagctcgcgcctcaatgtcagctgcaaaaagtcacttaagtcctgggccactacagctgacaattcagagccagggctaagcgtgggactggcaagcgtgagggaaaactttaatgctccaaagctagcacccaaaaactgcatgctggaataagctctctttgtgtctccggtgatgccttccaaaatgtgagtgataaagcgtggtagtttttctttaatcatttgcgtaatagaaaagtcctgtaaataagtcactaggaccccagggaccacaatgtggtagcttacaccgcgtcgctgaagcatggttagtagagatgagagtctgaaaaacagaaagcatgcgctaaactaaggtggctattttcactgaaggaaaaatcactctttccagcagcagggtacccactgggtggcccttgcggacatacaaaaatcggtccgtgtgattaaaaagcagcacagtaagttcctgtcttcttccggcaaaaatcacatcggactgggttagtatgtccctggcatggtagtcattcaaggccataaatctgccctgatatccagtaggaaccagcacactcacttttaggtgaagcaataccaccccatgcggaggaatgtggaaagattcagggcaaaaaaaattatatctattgctagccccttcctggacgggagcaatccctccaggactatctatgaaagcatacagagattcagccatagctcagcccgcttaccagtagacaaagagcacagcagtacaagcgccaacagcagcgactgactacccactgacttagctccctatttaaaggcaccttacactgacgtaatgaccaaaggtctaaaaaccccgccaaaaaaaacacacacgccctgggtgtttttgcgaaaacacttccgcgttctcacttcctcgtatcgatttcgtgacttaacttccgggttcccacgttacgtcacttttgcccttacatgtaacttagtcgtagggcgccatcttgcccacgtccaaaatggcttacatgtccagttacgcctccgcggcgaccgttagccgtgcgtcgtgacgtcatttgcatcaacgtttctcggccaatcagcagtagccccgccctaaatttaaaacctcatttgcatattaacttttgtttactttgtggggtatattagttttcgcgccaaaatgacctaatttcacttgcatccgcccagaattacctcatatccgggcgtggccgcgggaaaatcggccgtttccgggtttaaagtccgcttttttatacgtcatcagccccgcgacttgcttccgggctaggccacgcctccgcggcgaccgttagccgtgcgtcgtgacgtcatttgcatcaacgtttctcggccaatcagcagtagccccgccctaaatttaaaacctcatttgcatattaacttttgtttactttgtggggtatattagttttcgcgccaaaatgacctaatttcacttgcatccgcccagaattacctcatatccgggcgtggccgcgggaaaatcggccgtttccgggtttaaagtccgcttttttatacgtcatcagccccgcgacttgcttccgggctaggccacgcctccgcggcgaccgttagccgtgcgtcgtgacgtcatttgcatcaacgtttctcggccaatcagcagtagccccgccctaaatttaaaacctcatttgcatattaacttttgtttactttgtggggtatattattgatgatg

SEQ ID NO: 23 - DNA, 35177 bp, Adenovirus D20
  MISC_FEATURE (1)..(35177): Complete Genome
catcatcaataatataccccacaaagtaaacaaaagttaatatgtaaatgagcttttgaatttagggcggggccgacgctgattggccgttgcaagaaccgttagtgacgtcacgacgcacggccgacggccgccgcggaggcgtggcctagtccggaagcaagtcgcggggctgatgacgtataaaaaagcggactttagacccggaaacggccgattttcccgcggccacgcccggatatgaggtaattctgggcggatgcaagtgaaattaggccattttggcgcgaaaactgaatgaggaagtgaaaagtgaaaaataccgggcccgcccagggcggaatatttaccgagggccgagagactttgaccgattacgtgggggtttcgattgcggtgttttttcgtgaatttccgcgtccgtgtcaaagtccggtgtttatgtcacagatcagctgatccacagggtatttaaaccagtcgatcccgtcaagaggccactcttgagtgccagcgagtagagatttctctgagctccgctcccagagtctgagaaaaatgagacacctgcgcctcctgtcttcaactgtgcctattgacatggccgcattattgctggaggattatgtgagtacaatattggaggacgaactgcatccatctccattcgagctgggacctacacttcaggacctatatgatttggaggtagatgcccatgatgacgacccgaacgaagaggctgtgaatttaatatttccagaatctctgattcttcaggctgacatagccagcgaagctgtacctacaccacttcatacaccgactctgtcacccatacctgaattggaagaggaggacgagctagacctccgatgttatgaggaaggttttcctcccagcgattcagaggacgaacagggtgagcagagcatgactctaatctcagaatatgcttgtgtggttgtggaagagcattttgtgttggacaatcctgaggtgcccgggcaaggctgtagatcctgccagtaccaccgggataagaccggagacacgaacgcctcctgcgctctgtgttacatgaaaaagaacttcagctttatttacagtaagtggagtaaatgtgagagagactgagtgcttaacacataactgggtgatgcttaaacagctgtgctaagtgtggtttatttttgtttctaggtccggtgtcagaggatgagtcatcaccctcagaagaagaccacccgtgtccccctgagctgtcaggcgaaacgcccctgcaagtgcacagacccaccccagtcagacccagtggcgagaggcgagcagctgttgaaaaaattgaggacttgttacatgacatgggtggggatgaacctttggacctgagcttgaaacgccccaggaactaggctcagctgtgcttagtcatgtgtaaataaagttgtacaataaaagtatatgtgacgcatgcaaggtgtggtttatgactcatgggcgtggcttagtcctatataagtggcaacacctgggcactggggcacagaccttcagggagttcctgatggatgtgtggactatccttgcagactttagcaagacacgccggcttgtagaggatagttcagacgggtgctccgggttctggagacactggtttggaactcctctatctcgtctggtgtacacagttaagaaggattataacgaggaaattgaaaatctttttgctgattgctctggcctgctagattctctgaatctcggccaccagtcccttttccaggaaagggtactccacagccttgatttttccagcccagggcgcactacagccggggttgcttttgtggtttttctggttgacaaatggagccagaacacccaactgagcaggggctacattctggacttcgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcttgtacccagagcttagcaaggtgctgacatccatggccaggggagtgaagagggagaggagcgatgggggcaataccgggatgatgaccgagctgacggccagcctgatgaatcgcaagcgcccagagcgcattacatggcacgagctacagatggagtgcagggatgagttgggcctgatgcaggataaatatggcctggagcagataaaaacacattggttgaacccagatgaggattgggaggaggccattaagaaatatgccaagatagccctgcgcccagattgcaagtacatagtgaccaagaccgtgaatattagacatgcctgctacatttcgggtaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttctttggcttcaacaatatgtgcgccgaggtctggggcgcttccaagatcaggggatgtaagttttatggctgttggatgggcgtagtgggaagacccaagagcgagatgtctgtgaagcagtgtgtgtttgagaaatgctacctgggagtctctaccgagggcaatgctagagtgagacactgctcttccctggatacgggctgtttctgcctggtgaagggtacggcctctctgaagcataatatggtgaagggctgcacagatgagcgcatgtacaacatgctgacctgcgactcgggggtctgccatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaggtccagggtgcgcgcttgcgagtgcgggggcagacacaccaggatgcagcctgtggccctggatgtgacagaggagctgagaccagaccacctggtgatggcctgtaccgggaccgagttcagctccagcggggaggacacagattagaggtaggtttgagtagtgggcgtggctaatgtgagtataaaggtgggtgtcttacgagggtctttttgcttttctgcagacatcatgaacgggaccggcggggccttcgaaggggggctttttagcccttatttgacaacccgcctgccgggatgggccggagttcgtcagaatgtgatgggatctacggtggatgggcgcccagtgcttccagcaaattcctcgaccatgacctacgcgaccgtggggaactcgtcgctcgacagcaccgccgcagccgcggcagccgcagccgccatgacagcgacgagactagcctcgagctacatgcccagcagcggtagcagcccctctgtgcccagttccatcatcgccgaggagaaactgctggccctgctggccgagctggaagccctgagccgccagctggccgccctgacccagcaggtgtccgagctccgcgagcagcagcagcaaaataaatgattcaataaacacagattctgattcaaaagcaaagcatctttattatttattttttcgcgcgcggtaggccctggtccacctctcccgatcattgagagtgcggtggattttttccaggacccgatagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccgcccagatcccgccgggggttcatgttgtgcaggaccaccaggacggtgtagcctgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcataattatgctcctgggtgagatcatcataagacattttaatgaatttggggcggagggtgccagattgggggactatggttccctcggggcccggggcgaagttcccctcgcagatctgcatctcccaggctttcatctcggaggggggaatcatgtccacctgcggggcgatgaaaaagacggtttccggggcgggggtgatgagctgcgaggagaggaggtttctcagcagctgggacttgccgcacccggtcggaccgtagatgaccccgatgactggttgcaggtggtagttcaaggagatgcagctgccgtcgtcccggaggaggggggccacctcgttgagcatgtccctgacttggaggttttcccggacgagctcgccgaggaggcggtccccgcccagcgaaagcagctcttgcagtgaagcaaagtttttcaggggcttgagcccgtcggccatgggcatcttggcgagggtctgcgagaggagttccaaccggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagctcgtagttaagggcctcggcggcatggcccttggcgcggagctttcctttggaagagcgcccgcaggcgggacagaggagggattgcagggcgtagagcttgggcgctagaaagacggactcgggggcgaaggcgtccgctccgcagtgggcgcagacggtctcgcactcgacgagccaggtgagctcggggtgatcggggtcaaaaaccagttttcccccgttctttttgatgcgcttcttacctcgcgtctccatgagtctgtgtccgcgttcggtgacaaacaggctgtctgtgtccccgtagacggacttgatgggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccacggtatgcagacacatgtccccctcctccgcatccaagaaggtgattggcttgtaggtgtaggccacgtgacctggggtccccgacgggggggtataaaagggggcgggtctgtgctcgtcctcactctcttccgcgtcgctgtccacgagcgccagctgttggggtaggtattccctctcgagaacgggcatgacctcggcactcaggttgtcagtttctagaaacgaggaggatttgatgttggcctgccctgccgcgatgcttttgagtaaactttcatccatctggtcagaaaagacaatttttttattgtcaagcttggtggcaaaggagccatagagggcgttggagagaagcttggcgatggatctcatggtctgatttttgtcatggtcggcgcgctccttggccgcgatgttgagctggacatactcgcgcgcgacgcacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcaaaacgggggcagcacatccaggaggtgctcgtcgggggggtccgcatcgatggtgaagatgcccggacagagttccttgtcaaaataatcgatttttaaggatgcatcatccaaggccatctgccactcgcgggcggccagcgctcgctcgtaggggttgaggggcggaccccaaggcatgggatgtgtgagggcggaggcgtacatgccgcagatgtcgtagacatagatgggctccgagaggatgccgatgtaggtgggataacagcgccccccgcggatgctggcgcgcacgtagtcatacaactcgtgcgagggggccaagaaggcggggccgagattggtgcgctggggctgctcggcgcggaagacgatctggcgaaagatggcatgcgagtttgaggagatggtgggccgttggaagatgttaaagtgggcgtggggcaggcggaccgagtcgcggatgaagtgcgcgtaggagtcttgcagcttggcgacgagctcggcggtgacgaggacgtccatggcgcagtagtccagtgtttcgcggatgatgtcataacccgcctctcctttcttctcccatagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtctctgaccatgactttcaagaactggtacttgaagtccgagtcgtcgcagccgccgtgctcccagagctcgaaatcggtgcgcttcttcgagagggggttaggcagagcgaaagtgacgtcattgaagagaattttgcctgcccgcggcatgaaattgcgggtgatgcggaaagggcccgggacggaggctcggttgttgatgacctgggcggcgaggacgatctcgtcgaagccgttgatgttgtgcccgacgatgtagagttccatgaatcgcgggcggcctttgatgtgcggcagctttttgagttcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcacgctcccagcgatcccagcgtaagcgcacggcgagatcgcgagcgagggcgaccagctcggggtcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcatgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacaagggcgcgcagttgggagctgtccatggtgtcgcggagatccaggtcagggggcagggttctgaggttgacctcgtagaggcgggtgagggcgtgcttgagatgcagatggtacttgatttctacgggtgagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacttcggcgtggcgctcgggcaggtcccggtgctgcgccctgagagcgctggcgtgcgcgacgacgcggcggttgacatcctggatctgccgcctctgtgtgaagaccactggccccgtgactttgaacctgaaagacagttcaacagaatcaatctcggcgtcattgacggcggcctgacgcaggatctcttgcacgtcgcccgagttgtcctggtaggcgatctcggacatgaactgttcgatctcctcctcctggagatcgccgcggcccgcgcgctcgacggtggcggcgaggtcgttggagatgcgacccatgagctgcgagaaggcgcccaggccgctctcgttccagacgcggctgtagaccacgtccccgtcggcgttgcgcgcgcgcatgaccacctgcgcgaggttgagctccacgtgccgcgtgaagacagcgtagttgcgcaggcgttggaagaggtagttgagggtggtggcgatgtgctcggtgacgaagaagtacatgatccagcggcgcaggggcatctcgctgatgtcgccgatggcctccagcctttccatggcctcgtagaagtccacggcgaagttgaaaaactgggcgttgcgggccgagaccgtgagctcgtcttccaggagccggatgagctcggcgatggtggcgcgcacctcgcgctcgaaatccccgggggtctcctcctcttcctcttcttccatgacgacctcttcttctatttcttcctctgggggcggtggtggtggcggggcgcgacgacgacggcgacgcaccgggagacggtcgacgaagcgctcgatcatctccccgcggcggcgacgcatggtttcggttacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctttcaatgtcatcactggcggaggcagagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaggtgcagttggccatgagcgaccagttaacggtctgcaagccgggctgcacgacctccgagtacctgagccgcgagaaggcgcgcgagtcgaatacgtagtcgttgcaggtgcgcacgaggtactggtatccgactagaaagtgcggcggcggctggcggtagagcggccagcgctgggtggccggcgcgcccggggccaggtcctcgagcatgaggcggtggtagccgtagacgtagcgggacatccaggtgatgccggcggcggtggtggaggcgcgcgggaactcgcggacgcggttccatatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccaagcccgatagccgccaggatacggcggagagccctttttgccggccgaggggggtcgctagacttgaaagcggccgaaaaccctgccgggcagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgagtgcagctgcaaaaggacgtgcgcccggcgtacgtgcctgcgcagaacctgttcagggaccgcagcggggaggagcccgaggagatgcgcgactgccgttttcgggcgggcagggagctgcgcgagggcctggactgccagcgcgtgctgcgcgacgaggatttcgagccgaacgagcagacggggatcagccccgcgcgcgctcacgtggcagcggccaacctggtgacggcctacgagcagacggtgaagcaggagcgcaacttccaaaagagtttcaacaaccatgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggccgctggctgctggagctgattaacatcttgcagagcattgtagtgcaggagcgcagcctgagcttggccgagaaggtggcggctatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcattcacaaggccgtgagcacgagccggcggcgcgagctaagcgaccgcgagttgatgctgagcctgcgccgggcgctggtagggggcgcctccggcggcgaggagtcctacttcgacatgggggcggacctgcattggcagccgagccggcgcgccttggaggccgtctatggtccagaggacttggatgaggaagaggaagaggaggaggatgcacccgttgcggggtactgacgcctccgtgatgtgtttttagatgtcccagcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactttcggccattctggaggcggtggtcccctctcggaccaaccccacgcacgagaaggtgctggcgatcgtgaacgcgctggcggagaacaaggccattcgtcccgacgaggctgggctggtatacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattataccaactttatcagcgcgctgcggctgatggtgaccgaggttccccagagcgaggtgtaccagtcgggcccggactactttttccagactagcagacagggcctgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagtgtgaaccgcaactcgtacctgggtcacctgctgacgctgtaccgcgaggccataggccaggcacaggtggacgagcagaccttccaggagatcactagtgtaagccgcgcgctggggcagaacgacaccgacagtctgagggccaccctgaacttcttgctgaccaatagacagcagaagatcccggcgcagtatgcgctgtcggccgaggaggagcgcatcctgagatatgtgcaacagagcgtagggctgttcctgatgcaggagggggccacccccagcgccgcgctggacatgaccgcgcgcaacatggaacctagcatgtacgccgccaaccggccgtttatcaataagctgatggactacctgcaccgcgcggcgtccatgaactcggactactttaccaatgccattttgaacccgcactggctcccgccaccggggttctacacgggcgagtacgacatgcccgaccccaacgacgggtttctgtgggacgatgtggacagcgcggtgttttccccgaccttgcaaaagcgccaggaggcggtgcgcacgcccgcgagcgagggcgcagtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggagcctgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccagactggggcgacggatgttttgaatgcaaaataaaactcaccaaggccatagcgtgcgttctcttccttgttagagatgaggcgtgcgatggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtacttggtggacaacaagtcggcggacatcgcttccctgaactaccaaaacgaccacagcaacttcctgaccacggtggtgcagaacaacgatttcacccccgccgaggctagcacgcagacgataaattttgacgagcggtcgcggtggggcggtgatctgaagaccattctgcacaccaacatgcccaatgtgaacgagtacatgttcaccagcaagtttaaggcgcgggtgatggtggctaggaagcacccagatggtgtagacaaagatgatttaagcaaggatatcttagagtatgagtggtttgagtttaccctgcccgagggcaacttttccgagaccatgaccatagacctgatgaacaacgccatcttggaaaactacttgcaagtggggcggcaaaatggcgtgctggagagcgatattggagtcaagtttgacagcaggaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagtagggggcaacatccccgccctcctgaatgtcaaggagtatctgaaggataaggaagaagctggcacagcagatgcaaataccattaaggctcagaatgatgcagtcccaagaggagataactatgcatcagcggcagaagccaaagcagcaggaaaagaaattgagttgaaggccattttgaaagatgattcaaacagaagctacaatgtgatcgagggaaccacagacaccctgtaccgcagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggttggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgcttccgctgcgcagcagtatccgcggagtccagcgagtgaccgtcactgacgcccgtcgccgcacctgtccctacgtctacaaggccctgggcatagtcgcgccgcgcgtgctatccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggagcttacaagcgcgggcggactgccaccgccgccgccgtgcgcaccaccgttgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagtacgcccgccatgcgcgccgcccgggctctgctgcgccgcgccagacgcacgggccgccgggccatgatgcgagccgcgcgccgcgccgccactgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagtttgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgaaaacatgtatccgaccatgcagatcatggtgcctaagcgcaggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgtctccacttctaccgccgccacggccaccgagcctcccaggaggcgaagatggggccccgccaaccggctgatgcccaactacgtgttgcatccttccatcatcccaacgccgggctaccgcggcacccggtactacgccagccgcagacgcccagccagcaaacgccgccgccgcaccacccgccgccgtctggcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcactgggcagttgttaagagaaaagctcaaagatcaaaacttccagcagaaggtggtggacgggctggcctctggcattaacggggtggtggacatcgcgaaccaggccgtgcagcgcgaaataaacagccgcctggacccgcggccgcccacggtggtggagatggaagatgcaactcctccgccgcccaagggcgagaagcggccgcggccagatgcggaggagacgatcctgcaggtggacgagccgccctcgtacgaggaggccgttaaggccggcatgccgaccacgcgcatcatcgcaccgctggccacgggtgtaatgaaacccgccacccttgatctgcctccaccacccacgcccgctccaccgaaggcagctccggttgtgcagccccctccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtttggtgcagtttgcccgcgccaccgacacgtacttcagcctgggcaacaagtttaggaaccccacggtggctcccacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggcgcccccaactccagtcagtggcttgcaaaagataccaatgctgctggtcaaccagataaaactcacacctatggcgttgcagccatgggtggagaagacattacagaaaagggtcttcaaattggcattgatgaaactaaagaagaaaataacaagatatttgccaatgaaatataccaaccagaacctcaagtgggagaagaaaactggcaggaaacatttgttttttatggcggtagagctcttaagaaggataccaaaatgaaaccatgctatggctcatttgccagacctactaatgaaaagggaggtcaggctaaatttgtacttgatcaggaaggaaagccaactaaaaatcatgacatcacaatggctttctttgatactcctggtgggcaattaaatggaaaagatgaacttaaggcagacattgtcatgtacactgaaaatgtcaacctggaaacacctgacacccatgttgtttacaaacctggaaaagaggatgacagttcagaaatcaatttggttcaacagtccatgcccaacagacccaactacattggcttcagggacaactttgtagggcttatgtattacaacagcactggcaacatgggtgtgctggcaggtcaggcctctcagttgaatgctgtggtagacttgcaagacagaaacacagagctgtcttaccagctcttgctagattcgctgggtgacagaaccagatactttagcatgtggaactctgcggtggacagctatgatccagatgtcaggatcattgagaatcatggtgtggaagatgaacttccaaactattgcttcccattggatggtgctggaactaatgcagtttaccaaggtgtaaaaattacagatggaaatgatggcgatgtcaatgatgactgggaaaaagacaccgcagtatctgaacgtaatcagatatgcaaaggcaatatctatgctatggagatcaacctccaggccaacctgtggaagagttttctgtactcgaacgtggccctgtacctgcccgactcctacaagtacacgccggccaacgtcacgctgcccgccaacaccaacacctacgagtacatgaacggccgcgtggtagccccctcgctagtggacgcctacatcaacatcggcgcccgctggtcgctagaccccatggacaatgtcaaccccttcaaccaccaccgcaatgcgggcctgcgctaccgttccatgcttctgggcaatggccgctacgtgcccttccacatccaagtgccccaaaagttctttgccatcaagaacctgctcctgctccccggctcttacacctacgagtggaactttcgcaaggacgtcaacatgatcctgcagagttccctcggaaacgacctgcgcgtcgacggcgcctccgtccgcttcgacagcgtcaacctctacgccaccttcttccccatggcgcacaataccgcctccaccctggaagccatgctgcgcaacgacaccaacgaccagtccttcaacgactacctctcggcagccaacatgctttaccccatcccggccaaggccaccaacgtgcccatttccatcccctcgcgcaactgggccgccttccgcggctggagtttcacccggctcaagaccaaggaaactccatcccttggctcgggtttcgacccctactttgtctactcgggctccatcccctacctcgacgggaccttctacctcaaccacaccttcaaaaaggtctccatcatgtttgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccattacaacatcggttaccagggcttccatgtgcccgagggctacaaggaccgcatgtactccttcttccgcaacttccagcccatgagcaggcaggtggtcgatgagatcaactacaaggactacaaggccgtcaccctgccattccagcacaacaactctggcttcaccggctacctcgcacccaccatgcgtcaggggcagccctaccccgccaacttcccctacccgctcatcggccagacagccgtgccatccgtcacccagaaaaagttcctctgcgacagagtcatgtggcgcatccccttctccagcaacttcatgtccatgggcgcccttaccgacctgggtcagaacatgctctacgccaactcggcccacgcgctcgacatgacctttgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgcctttggctggaacccgcgctcgcgcacctgctacatgttcgacccctttgggttctcggaccgccggctgaagcagatttacagcttcgagtacgaggccatgctacgccgcagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctacccaccctccggcgcaaccaggaggagctctaccgcttcctcgcgcgccactccccttactttcgatcccaccgcgccgccatcgaacacgccaccgcttttgataaaatgaaacaactgcgtgtatctcaataaacagcacttttattttacatgcactggagtatatgcaagttatttaaaagtcaaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccgggccggagatcttgaaatcgcagttggggccggtgttttgcgcgcgcgagttgcggtacacggggttgcagcactggaacaccatcagactggggtacttcacactggcaagcacgctcttgtcgctgatctgatccttgtccaggtcctcggcgttgctgaggccgaacggggtcatcttgcacagctggcggcccaggaagggcacgctctgaggcttgtggttacactcgcagtgaacgggcattagcatcattcccgcgccgcgctgcatattcgggtagagggccttgacaaaggccgcgatctgcttgaaagcttgctgggccttggccccctcgctgaaaaacaggccgcagctcttcccgctgaactggttattcccgcatccggcatcctgcacgcagcagcgcgcgtcatggctggtcagttgcaccacgctccgtccccagcggttctgggtcaccttggccttgctgggttgctccttcagcgcgcgctgcccgttctcactggttacatccatctccaccacgtggtccttgtgaatcatcaccgttccatgcagacacttgagctggccttccacctcggtgcagccgtgatcccacaggacgcatccggtgcactcccagttcttgtgcgcgatcccgctgtggctgaagatgtaaccttgcaagaggcgacccatgatggtgctaaatgctttctgggtggtgaaggtcagttgcagaccgcgggcctcctcgttcatccaggtctggcacatcttttggaagatctcggtctgctcgggcatgagcttgtaagcatcgcgcaggccgctgtcgacgcggtagcgttccatcagcacgttcatggtatccatgcccttctcccaagacgagaccagaggcagactcagggggttgcgcacgtttaggacaccgggggtcgctggctcgacgatgcgttttccgtccttgccttccttcaacagaaccggcggctggctgaatcccactcccacgatcacggcatcttcctggggcatctcttcgtcggggtctaccttggtcacatgcttggtctttctgggctgcttcttttttggagggctgtccacggggaccacgtcctcctcggaagacccggagcccacccgctgatactttcggcgcttggtgggcagaggaggcggcggcgaggggctcctttcctgctccggcggatagcgcgctgaaccgtggccccggggcggagtggcctctcggtccatgaaccggcgcacgtcctgactgccgccggccattgtttcctaggggaagatggaggagcagccgcgtaagcaggagcaggaggaggacttaaccacccacgagcaacctaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctagccgaccggagcgaaacccccctcagcgtcgaggagctgtgtcgggcctacgagctcaacctcttctcgccgcgcgtgccccccaaacgccagcccaacggcacatgcgagcccaacccgcgtcttaacttctatcccgtctttgcggtccccgaggccctggccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggcttggtcgggacgagacgcgcgcggcaaatgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaagccctcgatgaaagtcaggagcagcgccccgaggacgcccggcccgtggtcagcgacgagcagctcgcgcgttggctcgggacccgcgacccccaggctttggaacagcggcgcaagctcatgctggccgtggtcctggtcaccctcgagctcgaatgcatgcgccgcttcttcagcgaccccgagaccctgcgcaaggtcgaggagaccctgcactacacttttagacacggtttcgtcaggcaggcatgcaagatctccaacgtggagctgaccaacctggtctcctgcctggggatcctgcatgagaaccgcctggggcagaccgtgctccactctaccctgaagggcgaggcgcggcgggactatgtccgcgactgcgtctttctctttctctgccacacatggcagtcggccatgggagtgtggcagcagtgtctcgaggacgagaacctgaaggagctggacaagcttcttgctagaaaccttaaaaagctgtggacgggcttcgacgagcgcaccgtcgcctctgacctggccgagatcgtgttccccgagcgcctgaggcagacgctgaaaggcgggctgcctgacttcatgagccagagcatgttgcaaaattaccgcactttcattctcgagcggtctgggatgctgcccgccacctgcaacgccttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgcccgcagcacgcggatctcacggcctgcgtcatcacccagggcgcgatccttgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgcagctccggccaagcctcctcgtagatgggatcgagtgaagggtgacggtaagcacgagcggcagggctaccgatcatggagggcccacaaagccgcgatcatcgcctgcttgcaagactgcggggggaacatcgcttttgcccgccgctacctgctcttccaccgcggggtgaacatcccccgcaacgtgttgcattactaccgtcaccttcacagctaagaaaaagcaagtaagaggagtcgccggaggaggcctgaggatcgcggcgaacgagcccttgaccaccagagagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggctcagtgccggcccttcgatgatctcacgggtcaacggggtccgtaaccatcgaaaccaaatattgttggaacaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagcttaacgacgagttggtgagctcttcgatcggtctgcgaccggacggagtgttccaactagccggagccgggagatcgtccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagcttgctcggttgaggcatctggaccactgccgccgcctgcgctgctttgcccgggagagctgcggactcatctactttgagtttcccgaggagcaccccaacggacctgcacacggagtgcggatcaccgtagagggcaccaccgagtctcacctggtcaggttcttcacccagcagcccttcctggtcgagcgggaccggggcgccaccacctacaccgtctactgcatctgtccaaccccgaagttgcatgagaatttttgctgtactctgtgtgctgagtttaataaaagctaaactcctacaatactctgggatcccgtgtcgtcgcactcgcaacgagaccttcaacctcaccaaccagactgaggtaaaactcaactgcaagccaggagataaatatatcctctggctctttgaaaacacttcattcgcagtctccaacacctgcgccaacgacggtattgaaatacccaacaaccttaccagtggactaacttacactaccagaaagactaagctagtactctacaatccttttgtagagggaacctaccactgccagagcggaccttgcttccacactttcactttggtgaacgttaccgacagcagcacagccgctccagaaacatctaaccttctttctgatactaacactcctaaaaccggaggtgagctctgggttccctctctaacagaggggggtaaacatattgaagcggttgggtatttgattttaggggtggtcctgggtgggtgcatagcggtgctgtattaccttccttgctggatcgaaatcaaaatctttatctgctgggtcagacattgttgggaggaaccatgaaggggctcttgctgattatcctttccctggtggggggtgtactgtcatgccacgaacagccacgatgtaacatcaccacaggcaatgagaggagtgtgatatgcacagtagtcatcaaatgcgaacataaatgccctctcaacatcacattcaaaaaccgtaccatggggaatgcatgggtgggcgactgggaaccaggagatgagcagaactacacggtcactgtccatggtagcaatggaaatcacactttcggtttcaaatttatttttgaagttatgtgtgatatcacactgcatgtggctagacttcatggcttgtggccccctaccaaggataacatggttgggttttctttggcttttgtgatcatggcctgtgcaatgtcaggtctgctggtaggggctataatgtggttcctgaggcacaagcccaggtacggaaatctggaaaaggaaaaattgctataaatgtttttctttccacagcatcatgaatacagtgatccgtatcgtgctgctctctcttcttgtagcttttagtcaggcagaatttcatactatcaatgctacatggtgggataatataactttagtgggaccctcagatattccagtcacatggtatgatagcactggattgaaattttgtgatggaagtacagttaagaatccacagatcagacatagttgtaatgaacaaaacttaactctgattcatgtgaacaaaacccatgaaagaacatacatgggctataataaacagagtactcataaggaagactataaagttatagtaatacctcctcctcctcctgctactgtaaagccacaaccagaaccagaatatgtgtttatttatattggagacaacaaaactctagaaggtcctccaggtcctccagtcacttggtttaatcaggatggaaagaaattttgcgaaggggaaagagtttatcatccagaatacaatcacacatgtgacaaacaaaaccttatactgctgtttgtaaattttacacatgatggagcttatcttggttacaattatcaaggaactcaaaggacacagtatgaggttacagtcttagatctttttccaaactctggtcaaatgaaaattgaagaacatagtgaggaaacagaacaaaagaatgggcaaaagcaaaatgaagaacaaaaacatggtgatcaaaaaacaagtcaaacaaaagttaatgacaggcgaaaagcagcgcagaaaagaccatcaaagctaaaaccagcaactattgagacaatgcttgttacagtaactgctggttctaacttaactttagttgggcctaaaccagaaggaaaagttacttggttcgatggagatttaaaaagaccatgtgagcctaattatagactgagacatgaatgtaatactcaaaacttaactctaatcaatgtaactaaaggttatgagggaacttactatggtactaatgacaaagatgaaggcaaaaggtacagagtgaaagtaaatactacaaattctcaagctgtaaaaattcagccatataccagacctactactcctgatcagaatcacaaatttgaaatgcaaattgaaaatggaaatgacgaatcaaaaataccctcaactactgtggcaattgtggtgggtgtgattgcgggcttcataactctaatcattgtctttatatgctacatctgctgccgcaagcgtcccaggtcatacaatcatatggtagacccactactcagcttctcttactgaaactcagttactctcatttcagaaccatgaaggctttcacagcttgcgttctgattagtttagtcacacttagtctatctcaaattatcaatgttaatgttaccagaggtggtagcatcacattaaatggaacctatccgcaaactacatggacaagatatcacacaaatggatggaaaaaaatatgtgaatggaatgttacagcctataaatgcttcagtaatggaagcattacaattactgccactgctaatattacttctggcaaaatcaaggcagaaagctataaaaatgaaattaagaaaatggtatataggaataacaagacaacatttgaagattctggagattatgaatatcagaaattatctttttatatgctaacaattattgagcttccaactactaaggctcccaccacaattaggacaactgttgagaccactactcacactacgcagttagacactacagtacagaatagtactgtattggttaggtttttgttgagggaggaaagtactactgaacagacagaggctacctcaagtgccttcagcagcactgcaaatttaacttcgcttgcttggactaatgaaaccggagtatcattgatgcatggccagccttactcaggtttggatattcaaattacttttctggttgtctgtggaatctttattcttgtggttcttctgtactttgtctgctgcaaagccagagagaaatctaggaggcccatctacaggccagtgattggggaacctcagcccctccaagtggatggaggcttaagaaatcttctcttctcttttacagtatggtgatcggccatgattcctaggttcttcctatttaacatcctcttctgtctattcaacatctgcgctgccttcgcggccgtctcgcacgcctcgcccgactgtctagggcctttccccacctacctcctatttgccctgctcacctgcacctgcgtctgcagcattgtctgcgtggtcatcaccttcctgcagctcatcgactggtgctgcgcgcgctacaattacctgcatcatagtcccgaatacagggacgagaacgtagccagaatcttaaggctcatctgaccatgcagactctgctcatactgctagccctcctatcccctgtcctcacaacttatgctgattactctaaatgcaaattcgcggacatatggaatttcttagattgctatcaggagaaaattgatatgccatcctattacttggtgattgtgggaatagtcatggtctgctcctgcactttctttgccatcatgatctacccctgttttgatctcggttggaactctgttgaggcattcacatacacactagaaagcagttcactagcctccacgccaccacccacaccgcctccccgcagaaatcagtttcccatgattcagtacttagaagagccccctccccggcccccttccactgttagctactttcacataaccggcggcgatgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctgctcaagaccctttgcggactccgcgacctcctccccatgaactgatgttaattaaaagcccaaaaaccaatcagccccttcccccatttccaatcccccaattactcataaaaataaatcattggaactaatcattcaataaagatcactcacttgaaatctgaaagtatgtctctggtgtagttgttcagcagcacctcggtgccctcctcccagctctggtactccagtccccggcgggcggcaaacttcctccacaccttgaaagggatgtcaaattcttggtccacaattttcattgtcttccctctcagatgtcaaagaggctccgggtggaagatgacttcaaccccgtctacccctatggccacgcgcggaatcagaatatccccttcctcactcccccctttgtctcctccgatggattacaaaacttcccccctggtgtcctttcgctaaaactggctgatccaatcgccattgtcaatgggaatgtttcactcaaggtgggagggggaatcactgtggaacaagatagtggacagctaattgcgaatcctaaggctcccttgcaagttgcaaatgacaaattagagctttcttatgcatatccatttgaaactagtgctaataaacttagtttaaaagtagggcaaggactaaaagtgttggatgaaaaagattctggaggattgcaaaatttacttggcaaacttgtagttttaactggaaaaggaataggtgttgaagagttaaaaaaccctgataatactaataggggagttggaattaatgtaagactgggcaaagatggaggtttgtcctttaataaaaatggtgagttagtagcgtggaacaaacacaatgacacacgcactctttggacaactccagacccttctccaaattgtaaaattgaggaagttaaagactcaaaacttactttggttcttacaaaatgcggaagtcagatattggctactatggcttttcaagttgtgaagggaacttatgaaaatatcagtaagaacacagcaaaaaatagcttctcaattaaattgttatttgatgataatggaaaacttttagaaggatctagtttagataaagattattggaacttcagaagtgatgattctattatacccaatcaatacgacaatgcagtgccgtttatgccaaacctaaaagcttatcctaaaccttcaactgtcttgccatctactgacaaaaatagtaatgggaaaaatactattgtttctaacctttatctggaaggaaaggcatatcagccagttgcggttaccattacttttaacaaagagattggctgtacttattcaataacatttgactttggatgggctaaaacctatgatgttccaattccatttgattcttcctcatttaccttctcctatattgcccaagaaaacaaagacacgaacaaataaaatgtttttgaaatgaattatgtatctttattgatttttacaccagcacgggtagtcagtctcccaccaccagcccatttcacagtgtacacggttctctcagcacgggtggccttaaatagggaaatgttctgattagtgcgggaactggacttggggtctataatccacacagtttcctggcgagccaaacgggggtcggtaattgagatgaagccgtcctctgaaaagtcatccaagcgggcctcacagtccaaggtcacagtctggtggaacgagaagaacgcacagattcatactcggaaaacaggatgggtctgtgcctctccatcagcgcccttagcagtctctgccgccggggctcggtgcggctgctgcagatgggatcgggatcgcaagtctctttgactatgatccccacagcctttagcatcagtctcctggtgcgtcgggcacagcaccgcatcctgatctctgccatgttctcacagtaagtgcagcacataatcaccatgttattcagcagcccataattcagggtgctccagccaaagctcatgttggggatgatggaacccacgtgaccgtcgtaccagatgcggcagtatatcaggtgcctgcccctcataaacacactgcccatatacatgatctctttgggcatgtctctgttcacaatctgacggtaccatgggaaacgctggttgaacatgcacccgtaaatgactctcctgaaccacacggccagcagggtgcctcccgcccgacactgcagagagcccggggatgaacagtggcaatgcaggatccagcgctcgtacccgctcaccatctgagctcttaccaagtccagggtagcggggcacaggcacactgacatacatctttttaaaatttttatttcctctggggtcaggatcatatcccaggggactggaaactcttggagcagggtaaagccagcagcacatggtaatccacggacagaacttacattatgataatctgcatgatcacaatcgggcaacaggggatgttgttcagtcagtgaagccctggtctcctcatcagatcgtggtaaacgggccctgcgatatggatgatggcggagcgagctggattgaatctcggtttgcattgtagtggattctcttgcgtaccttgtcgtacttctgccagcagaaatgggcccttgaacagcagatacccctcctgcggccgtcctttcgctgctgccgctcagtcatccaactgaagtacatccattctcgaagattctgaagaagttcctctgcatctgatgaaataaaaaacccgtccatgcgaattcccctcatcacatcagccaggactctgtaggccatccccatccagttaatgctgccttgtctatcattcagagggggcggtggcaggattggaagaaccatttttattccaagcggtctcgaaggacgataaagtgcaagtcacgcaggtgacagcgttccccgccgctgtgctggtggaaacatacagccagatcaaaacccactctattttcaaggtgctcgactgtggcttcgagcagtggctctacgcgtacatccaacataagaatcacattaaaggctggccctccatcgatttcatcaatcatcaggttacattcctgcaccatccccaggtaattctcatttttccagccttggattatttctacaaattgttgatgtaagtccactccgcacatgtggaaaagctcccacagtgccccctccactttcataatcaggcagaccttcataatagaaacagatcctgctgctccaccacctgcagcgtgttcaaaacaacaagattcaataaggttctgccctccgccctgagctcacgcctcaatgtcagctgcaaaaagtcacttaagtcctgggccactacagctgacaattcagagccagggctaagcgtgggactggcaagcgtgagggaaaactttaatgctccaaagctagcacccaaaaactgcatgctggaataagctctctttgtgtctccggtgatgccttccaaaatgtaagtgataaagcgtggtagtttttctttaatcatttgcgtaatagaaaagtcctctaaataagtcactaggaccccagggaccacaatgtggtagcttacaccgcgtcgctgaagcatggttagtagagatgagagtctgaaaaacagaaagcatgcactaaactaaggtggctattttcactgaaggaaaaatcactctctccagcagcagggtacccactgggtggcccttgcgaacatacaaaaatcggtccgtgtgattaaagagcagcacagtaagctcctgtcttctcccggcaaagatcacatcggactgggttagtatgtccctggcatggtagtcattcaaggccataaatctgccctgatatccagtaggaaccagcacactcacttttaggtgaagcaataccaccccatgcggaggaatgtggaaagattgagggcaaaagaaattatatctattgctagtcccttcctggacgggagcaatccctccagggctatctatgaaagcatacagagattcagccatagctcagcccgcttaccagtagacagagagcacagcagtacaagcgccaacagcagcgactgactacccactgacctagctccctatttaaaggcaccttacactgacgtaatgaccaaaggtctaaaaaccccgccaaaaaaaacacacacgccctgggtgttttttgcgaaaacacttccgcgttctcacttcctcgtatcgatttcgtgactcaacttccgggttcccacgttacgtcacttctgcccttacatataactcaatcgtagggcgccatcttgcccacgtccaaaatggcttccatgtccagccacgcctccgcggcggccgtcggccgtgcgtcgtgacgtcactaacggttcttgcaacggccaatcagcgtcggccccgccctaaattcaaaagctcatttacatattaacttttgtttactttgtggggtatattattgatgatg

SEQ ID NO: 24 - DNA, 35727 bp, Adenovirus D24
  MISC_FEATURE (1)..(35727): Complete Genome
catcatcaataatataccccacaaagtaaacaaaagttaacatgcaaatgagcttttgaatttagggcggggccagcgctgattggacgagagaagatgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtaaaattaggtcattttggcgcgaaaactgaatgaggaagtgaaaagtgaaaaataccggtcccgcccagggcggaatatttaccgagggccgagagactttgaccgattacgtgggggtttcgattgcggtgttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtctgagaaaaatgagacacctgcgcctcctttcttcaactgtgcctattgacatggccgcattattgctggaggattatgtgagtacaatattggaggacgaactgcatccatctccatttgagctgggacctacacttcaggacctatatgatttggaggtagatgcccatgatgacgacccgaacgaagaggctgtgaatttaatatttccagaatctctgattcttcaggctgacatagccagcgaagctgtacctacaccacttcatacaccgactctgtcacccatacctgaattggaagaggaggacgagctagacctccgatgttatgaggaaggttttcctcccagcgattcagaggacgaacagggtgagcagagcatggctctaatctcaaaatatgcttgtgtggttgtggaagagcattttgtgttggacaatcctgaggtgcccgggcaaggctgtagatcctgccagtaccaccgggataagaccggagacacgaacgcctcctgcgctctgtgttacatgaaaaagaacttcagctttatttacagtaagtggagtgaatgtgagagagactgagtgcttaacacataactgggtaatgcttaaacagctgtgctaagtgtggtttatttttgtttctaggtccggtgtcagaggatgagtcatcaccctcagaagaagaccacccgtgtccccctgagctgtcaggcgaaacgcccctgcaagtgcacagacccaccccagtcagacccagtggcgagaggcgagcagctgttgaaaaaattgaggacttgttacatgacatgggtggggatgaacctttggacctgagcttgaaacgccccaggaactaggctcagctgtgcttagtcatgtgtaaataaagttgtacaataaaagtatatgtgacgcatgcaaggtgtggtttatgactcatgggcgtggcttagtcctatataagtggcaacacctgggcactggggcacagaccttcagggagttcctgatggatgtgtggactatccttgcagactttagcaagacacgccggcttgtagaggatagttcagacgggtgctccgggttctggagacactggtttggaactcctctatctcgtctggtgtacacagttaagaaggattataacgaggaatttgaaaatctttttgctgattgctctggcctgctagattctctaaatctcggccaccagtcccttttccaggaaagggtactccacagccttgatttttcaagcccagggcgcactacagccggggttgcttttgtggtttttctggttgacaaatggagccagaacacccaactgagcaggggctacattctggacttcgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcagggtgctgacatccatggccaggggagtgaagagggagaggagcgatgggggcaataccgggatgatgaccgagctgacggccagcctgatgaatcgcaagcgtccagagcgcattacctggcacgagctacagatggagtgtagggatgaggtgggcctgatgcaggataaatatggcctggagcagataaaaacccactggttgaacccagatgaggattgggaggaggccattaagaaatatgccaagatagccctgcgcccagattgcaagtacagggtgaccaagacggtgaatatcagacatgcctgctacatctcggggaacggggcagaggtggtcatcgataccctggacaaggccgccttcaggtgttgcatgatgggaatgagagccggagtgatgaatatgaattccatgattttcatgaacatgaagttcaatggagagaagtttaatggggtgatgttcatggccaacagtcacatgaccctgcacggctgcagtttcttcggcttcaacaatatgtgcgcagaggtctggggcgctgctaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacattgctcttccctggagacgggctgcttctgcctggtgaagggcacagcctctctgaagcataatatggtgaagggctgcacggatgagcgcatgtacaacatgctgacatgcgactcgggggtctgccatatcctgaagaacatccatgtgacctcccacccccggaagaagtggccagtgtttgagaataacctactgatcaagtgccacatgcacctgggcgccagaaggggcaccttccagccgtaccagtgcaactttagccagaccaagctgctgctggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcaaccagtggccctggatgtgaccgaggagctgaggcccgaccacctggtgatggcttgtaccgggaccgagttcagctccagtggggaggacacagattagaggtaggttgagtattagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggacgggcgtccagtgcttccagcaaattcctcgaccatgacctacgcgaccgtggggaactcgtcgctcgacagcaccgccgcagccgcggcagccgcagccgccatgacagcgacgagactggcttcgagctacatgcccagcagcagcagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcgaagcggttgagctgggagggatgcatgcggggggagatgatgtggagtttggcctggatcttgaggttggcgatgttgccacccagatcccgcctggggttcatgttgtgcaggaccaccagaacggtgtagcccgtgcacttggggaacttgtcatgcaacttggaagggaatgcgtgaaagaatttggagacgcccttgtgcccacccaggttttccatgcactcatccatgatgatggcgatgggcccgtgggctgcggctttggcaaagacgtttctggggtcagagacatcgtaattatgctcctgggtgagatcatcataagacattttaatgaatttggggcggagggtgccagattgggggacaatggttccctcgggccccggggcgaagttcccctcacatatttgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccggacgagctcgccgaggaggcggtccccgcccagcgagagcagctcttgcagggaagcaaagtttttcaggggcttgagcccgtcggccatgggcatcttggcgagggtctgcgagaggagttcgaggcggtcccagagctcggtgacgtgctctacggcatctcgatccagcagacttcctcgtttcgggggttgggacgactgcgactgtagggcacgagacgatgggcgtccagcgctgccagcgtcatgtccttccagggtctcagtgtccgcgtgagcgtggtctccgtcacggtgaaggggtgggccccgggctgtgcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggtgcgagaaagacggactcgggggcgaaagcatccgctccgcagtgggcgcagacggtctcgcactcgaccagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcggaccactctgagacgaaggcgcgcgtccacgccaagacaaaggaggccacgtgcgaggggtagcggtcgttgtccaccagggggtccaccttttccacggtatgcagacacatgtccccctcctccgcatccaagaaggtgattggcttgtaggtgtaggccacgtgacccggggtccccgacgggggggtataaaagggggcgggtctgtgctcgtcctcactctcttccgcgtcgctgtccacgagcgccagctgttggggtaggtattccctttcgagagcgggcatgacctcggcactcaggttgtcagtttctagaaacgaggaggatttgatgttggcttgccctgccgcaatgctttttaggagactttcatccatctggtcagaaaagactatttttttattgtcaagcttggtggcgaaggagccatagagggcgttggagagaagcttggcgatggatctcatggtctgatttttgtcacggtcggctcgctccttggccgcgatgttgagctggacatactcgcgcgcgacgcacttccattcggggaagacggtggtgcgctcgtcgggcacgatcctgacgcgccagccgcggttatgcagggtgaccagatccacgctggtggccacctcgccgcgcaggggctcgttggtccagcagaggcgtccgcccttgcgcgagcagaacgggggcagcacatcaagcagatgctcgtcaggggggtccgcatcgatggtgaagatgcccggacagagttccttgtcaaaataatcgatttttgaggatgcatcatccaaggccatctgccactcgcgggcggccagcgctcgctcgtaggggttgaggggcggaccccagggcatgggatgcgtcagggcggaggcgtacatgccgcagatgtcgtagacatagatgggctccgagaggatgccgatgtaggtgggataacagcgccccccgcggatgctggcgcgcacgtagtcatacaactcgtgcgagggggccaagaaggcggggccgagattggtgcgctggggctgctcggcgcggaagacgatctggcgaaagatggcatgcgagttggaggagatggtgggccgttggaagatgttaaagtgggcatgaggcagacgaaccgagtcgcggatgaagtgcgcgtaggagtcttgcagcttggcgacgagctcggcggtgacgaggacgtccatggcgcagtagtccagcgtttcgcggatgatgtcataacccgcctctcctttcttctcccatagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtatccctgaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcgaagccgttgatgttgtgcccgacgatgtagagttccatgaatcgcgggcggcctttaatgtgcggcagctttttgagctcctcgtaggtgaggtcctcggggcaatgcagtccgtgctgctcgagcgcccactcctggagatgtgggttggcttgcatgaatgaagcccagagctcgcgggccataagggtctggagctcgtcgcgaaagaggcggaactgctggcccacggccatcttttctggggtgacgcagtagaaagtaagggggtcccgctcccagcgatcccagcgtaagcgcacggctagatcgcgagcgagggcgaccagctctgggtcccccgagaatttcataaccagcataaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggctgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccaccggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctccacggtggcggcgaggtcattggagatgcgacccatgagctgcgagaaggcgcccaggccgctctcattccagacgcggctgtagaccacgtccccgtcggcgtcgcgcgcgcgcatgaccacctgcgcgaggttgagctccacgtgccgcgtgaagacggcgtagttgcgcaggcgctggaagaggtagtttagggtggtggcgatgtgctcggtgacgaagaagtacatgatccagcggcgcaggggcatctcgctgatgtcgccgatggcctccagcctttccatggcctcgtagaaatccacagcgaagttgaaaaactgggcgttgcgggccgagaccgtgagctcgtcctccaggagcctgatgagttcggcgatggtggcgcgcacctcgcgctcgaaatccccgggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttaaggcggcggatggtggcgaggaggaccaggtccttgggtcccgcttgctggatgcgaagccgctcggccatgccccaggcctggccctgacaccggctcaggttcttgtagtagtcatgcatgagcctctcaatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggccccggtgttgatggtgtaggtgcagttggccatgagcgaccagttgacggtctgcaggccgggttgcacgacctctgagtacctgagccgcgagaaggcgcgcgagtcgaagacatagtcgttgcaggtgcgcacgaggtactggtatccaactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccgaccgaggggagtcgctagacttgaaagcggccgaaaaccccgccgggtagtggctcgcgcccgtagtctggagaagctttgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccaccccccctccggcgaccaccgcgaccgcggccgtagcaggcgccggcgctgtagccccgccacagcagacagagatggacttggaagagggcgaagggctggcgagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccgttttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccatgtgcgcacgctaatcgcgcgcgaggaggtggccctgggcttgatgcacctgtgggacctggcggaggccatcgtgcagaacccggacagcaagcctctgacggcgcagctgttcctggtggtgcagcacagcagggacaacgaggcgttcagggaggcgctgctaaacatcgccgagcccgagggccgctggctgctggagctgatcaacatcttgcagagcatcgtagtgcaggagcgcagcctgagcctggccgagaaggtggcggctatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcgcgagccggcggcgcgagctgagcgaccgcgagctgatgctgagtctgcgccgggcgctggtagggggcgccgccggcggtgaggagtcctacttcgacatgggggcggacctgcattggcagccgagccggcgcgccttggaggccgcctacggtccagaggacttggatgaggatgaggaagaggaggaggatgcacccgctgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacaaacgtgcagtccaacctggaccggctggtgacggacgtgcgcgaggccgtggcgcagcgcgagcggttcaagaacgagggcctgggctcgttggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccagactactttttccagacgagccggcagggcttgcagacggtgaacctaagccaggctttcaagaatctgcgcgggctgtggggcgtgcaggcgcccgtgggcgaccggtcgacggtgagcagcttgctaacgcccaactcgcggctgctgctgctgctgatcgcgcccttcaccgacagcggcagcgtgaaccgcaactcgtacctgggccacctgctgacgctttaccgcgaggccataggccaggcgcaggtggacgagcagaccttccaggagatcactagcgtgagccgcgcgctgggtcagaacgacaccgacagtctgagagccaccctgaacttcttgctgacaaatagacagcagaagattccggcgcagtacgcgctgtcggccgaggaggagcgcatcctgagatatgtgcagcagagcgtagggcttttcctgatgcaggagggggccacccccagcgccgcgctggacatgaccgcgcgcaacatggaacctagcatgtacgccgccaaccggccgttcatcaataagctgatggactacctgcaccgcgcggctgccatgaactcggactactttactaatgctatactaaacccgcactggctcccgccgccggggttctacacgggcgagtacgacatgcccgaccccaacgatgggttcctgtgggacgacgtggacagcgcggtgttctccccgaccttgcaaaagcgccaggaggcggtacgcacgcccgcgagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccagactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcaaccctggaggttccgtttgtgcctccgcggtatatggctcctacggagggcagaaacagcattcgttactcggaactggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatttgaagaccattctgcacaccaacatgcccaatgtgaacgagtacatgttcaccagcaagtttaaggcgcgggtgatggtggctaggaaggtggtagatcagaatgataggagcaaggatgagttaaaatatgagtggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtaaccaagctggtgatgcctggggtctacacctacgaggccttccacccggacgttgtgctgctgccgggctgcggggtggacttcaccgagagccgcctgagcaacctcctgggcattcgcaagaagcaacctttccaagagggcttcaggatcatgtatgaggatctcgagggtggtaacatccccgccctcctggatgtcaagcaatatttggatagtaaaaagaagcttgaggaggcaacacagaatgcaaccagggctgctggagatatcagaggagacagtcatattccaagagctgtggaacaagcggctgaaaaggatctggtcattgtaccagtaacacaagatgaaagtaagagaagctataatgtcatagatggcacccatgacaccctctaccgaagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggttggcgccgagctcatgcccttccgcgccaagagcttttacaacgacctcgccgtctactcccagctcatccgcagctacacctccctcacccacgtcttcaaccgcttccccgacaaccagatcctctgccgtccgcccgcgcccaccatcaccacggtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttctaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagtacgcccgccatgcgcgccgcccgggctctgctgcgccgcgccagacgcacgggccgccgggccatgatgcgagccgcgcgccgcgccgccactgcaccccccgcaggcaggactcgcagacgagcggccgccgccgctgccgcggccatttctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgtttacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgttgccgctggacgagagcaaccccacgcctagcctgaagcccgtgaccctgcagcaggtgctgccccaagcagtgctgctgccgagccgcggggtcaagcgcgagggcgagaatatgtacccgaccatgcagatcatggtgcccaagcgccggcgcgtggaagaagtgctggacaccgtgaaaatggatgtggagcccgaggtcaaggtgcgccccatcaagcaggtggcgccgggcctgggcgtgcagaccgtggacattcagatccccaccgacatggatgttgacaaaaaaccctcgaccagcatcgaggtgcagaccgacccctggctcccagcctccaccgctgccgtctccacttctaccgccgccacggctaccgagcctcccagaaggcgaagatggggccctgccaaccggctgatgcccaactacgtattgcatccttccattatcccgacgccgggctatcgcggcacccggtactacgccagccgcaggcgcccagccagcaaacgccgccgccgcaccgccacccgccgccgtctggcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctcaaccgccgccggcggcgggccatgcgcaggcgcctgagtggcggctttctgcccgcgctcatccccataatcgcggcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaagctcaaagaccagaacttccagcagaaggtggtggacggcctagcctcgggcattaacggggtggtggacatagcaaaccaggccgtgcagcgcgagataaacagccgcctggacccgcggccgcccacggtggtggagatggaagatgcaactcctccgccgcccaagggcgagaagcggccgcggcccgacgcggaggagacgatcctgcaggtggacgagccgccctcgtacgaggaggccgtcaaggccggcatgcccaccacgcgtatcatcgcgccactggccactggtgtaatgaaacccgccacccttgacctgcctccgccacccacgcccgctccaccgaaggcagctccggttgtgcagccccctcctgtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggctaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcttacaacagcctggcccccaaaggcgcccccaactctagtcagtgggaacaagctaaagctaccaatgccggtcaaaaggaaactcacacatttggagtagccgctatgggcggagaagacattacagtgaaaggtcttcaaattggaactgatgaaactaaggaagatggagaggatgaaatttttgcagatcaaacattccagccagaacctcaagtgggagaacagaactggcaagaaacgtttgttttctatggaggcagagctcttaagaaagaaaccaaaatgaagccatgttatggctcttatgcgagacccacaaatgaaaagggaggacaggctaaatttacacttgatgaaaaaggtcagccaaccaaaattcctgatattacaatggatttctttgatagtccacaagatgatacatcaggtgtaactaataagccagatattgtcatgtatgcagaaaatgtaaatttagaagctcctgacacacatgtagtttacaaaccaggcaaagatgattctagttcttccgctaacctcacacaacaggccatgcctaacagaccgaactacatcgggttcagagacaactttgtgggtcttatgtactacaatagtactggcaacatgggtgtgctggctggtcaggcctctcagttgaatgctgtggtcgacttgcaagacagaaacaccgagctgtcttaccagctattgctagattctctgggtgacagaaccagatactttagcatgtggaattctgcagtggacagctatgaccccgatgtcaggatcattgagaatcacggtgtggaagatgaacttccaaactattgcttcccactgaatggcagtggttctaacagcacatacaaaggtgttaaagctggaactggaaacaattgggatgacgatgaaaatgttgcaagacaaaatcagattggcactggcaacctgttcgccatggagatcaacctccaggccaacctatggaagagttttctgtactcgaacgtggccctgtacctgcccgactcctacaagtacacgccggccaacgtcacgctgcccaccaacaccaacacctacgactacatgaacggccgcgtggtagccccctcgctggtggacgcctacatcaacattggcgcccgctggtcgctggaccccatggacaatgtcaatcccttcaaccaccaccgcaacgcgggcctgcgctaccgctccatgctcctgggcaacggccgctacgtgcccttccacatccaagtgccccaaaagttctttgccatcaagaacctgcttctgctccccggttcctacacctacgagtggaacttccgcaaggacgtcaacatgatcctgcagagttccctcggcaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaggaaactccctccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgttgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctacccttccagcacaacaactcgggcttcaccggctaccttgcgcccaccatgcgccaggggcagccctaccccgccaacttcccctacccgctcatcggctccaccgcagttccctccgtcacccagaaaaagttcctctgcgacagggtcatgtggcgcatcccattctccagcaactttatgtccatgggcgccctcaccgacctgggtcagaacatgctctatgccaactcggcccacgcgctcgacatgacctttgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgctaccacttaagcatgagcggctccagcgaacaagagctcgcggccatcgtgcgcgacctgggatgcgggccctactttttgggaacccacgacaagcgcttccctggcttccttgccggcgacaagctggcctgcgccatcgtcaacacggccggccgcgagaccggaggcgtgcactggctcgcctttggctggaatccgcgctcgcgcacctgctacatgttcgacccctttgggttctcggaccgccggctcaagcagatttacagcttcgagtacgaggccatgctgcgccgaagcgcgcttgcctcctcgcccgaccgctgtctcagcctcgagcagtccacccagaccgtgcaggggcccgactccgccgcctgcggacttttttgttgcatgtttttgcatgccttcgtgcactggcccgaccgacccatggacggaaaccccaccatgaacttgctgacgggggtgccaaacggcatgctacaatcgccacaggtgctgcccaccctcaggcgcaaccaggaggagctctaccgcttcctcgcgcgccactccccttactttcgatcccaccgcgccgccatcgaaaacgccaccgcttttgataaaatgaaacaactgcgtgtatctcaataaacagcactttattttacatgcactggagtatatgcaagttatttaaaagtcgaaggggttctcgcgctcgtcgttgtgcgccgcgctggggagggccacgttgcggtactggtacttgggaagccacttgaactcggggatcaccagtttgggcactggggtctcggggaaggtctcgctccacatgcgccggctcatctgcagggcgcccagcatgtccgggccggagatcttgaaatcacaattggggccggtgctctgcgcgcgcgagttgcggtacacggggttgcagcactggaacaccattagactggggtacttcacactggcaagcacgctcttgtcgctgatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacgaaggccgtgatctgcttgaaagcttgctgggccttagccccctcgctgaaaaacaggccgcagctcttcccgctaaactggttattcccgcacccggcatcatgcacgcagcagcgcgcgtcatggctggtcagttgcaccacgctacgtccccagcggttctgggtcaccttggccttgctgggctgctccttcaacgcgcgctgcccgttctcgctggtcacatccatctccaccacgtggtccttgtggatcatcaccgtcccatgcagacacttgagctgaccctcgacatcgcagcagccatgatcccacagggcgcagccggtgcactcccagttcttatgcgcgatcccgctgtggctgaagatgtaaccttgcaacaggcgacccatgacggtgctaaatgctttctgggtggtgaaggtcagttgcagaccgcgggcctcctcgttcatccaggtctggcacatcttttggaagatctcggtctgctcgggcatgagcttgtaagcatcgcgcaggccgctgtcgacgcggtagcgttccatcagcacgttcatggtatccatgcccttctcccaggacgagaccagaggcagactcagggggttgcgcacgttcaggacaccgggggtcgcaggctcgacgatgcgttttccgtccttgccttccttcaacagaaccggaggctggctgaatcccactcccacgattacggcatcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggtggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctccagcatggctacctgggaggagaggaggatgtgctgctaaaacacttgcagcgccaatccatcatcctccgggacgccctggccgaccggagcgaaacccctctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggccctagccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcaaacgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagcagctcgcgcgttggctcgggacccgcgacccccaggctttggaacagcggcgcaagctcatgctggccgtggtcctggtcaccctcgagctcgaatgcatgcgccgcttcttcagcgaccccgagaccctgcgtaaggtcgaggagaccctgcactacactttcaggcacggtttcgtcaggcaggcctgcaagatctccaacgtggagctgaccaacctggtctcatgcctggggatcctgcacgagaaccgcctgggacagaccgtgctccactctactctgaagggcgaggcgcgtcgggactatgtccgcgactgtgtatttctctttatctgccacacctggcaagcagccatgggcgtgtggcagcagtgtctcgaggacgaaaatctgaaggagctggacaagcttcttgctagaaaccttaaaaagctgtggacgggcttcgacgagcgcaccgtcgcctcggacctggccgagatcgtttttccagaacgcctgaggcagacgctgaaaggcgggctgcccgacttcatgagccagagcatgttgcaaaactaccgcactttcattctcgagcgatctgggatgctacccgccacctgcaacgcattcccctccgactttgtcccgctgagctaccgcgagtgtcccccgccgctgtggagccactgctatctcttgcagctggccaactacatcgcctaccactcggacgtgatcgaggacgtgagcggcgaggggcttctcgagtgccactgccgctgcaacctgtgctccccgcaccgctccctggtctgcaacccccagcttctgagcgagacccaggtcatcggtaccttcgagctgcaaggtccgcaggagtccaccgctccgctgaaactcacgccggggttgtggacttccgcgtacctgcgcaaatttgtacccgaggactaccacgcccatgaaataaagttcttcgaggaccaatcgcgcccacagcacgcggatctcacggcctgcgtcatcacccagggcgcgatcctcgcccaattgcacgccatccaaaaatcccgccaagagtttcttctaaaaaagggtagaggggtctacctggacccccagacgggcgaggtgctcaacccgggtctcccccagcatgccgaggaagaagcaggagccgctagtggagcagatggaagaagaatgggacagccaggcagaggaggacgaatgggaggaggagacagaggaggaagaattggaagaggtggaagaggagcaggaaacagagcagcccgtcgccgcaccatccgcgccggcagccccgccggtcacggatacaacctccacagctccggccaagcctcctcgtagatgggatcgagtgaagggtgacggtaagcacgagcggcagggctaccgatcatggagggtccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagaggagtcgccggaggaggcctgaggatcgcggcgaacgagccctcgaccaccagggagctgaggaaccggatcttccccactctttatgccatttttcagcagagtcgaggtcagcagcaagaactgaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggctcagtgccggcccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagtttataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggagctaccacctacaccgtctactgcatctgtcctaccccgaagttgcatgagaatttttgctgtactctttgtggtgagtttaataaaagctgaactaagaaccttctttggaatcccttgtcatcatcaaatcaacaagaccatcaacttcacctttgaggaacaggtgaactttacctgcaagccacacaagaagtacatcatctggttttatcacaacactactctagcagtagccaacacctgctcgaacgacggtgttctcctacctaacaatctcaccagtggactaaccttctcagttaaaagggcaaagctaattcttcatcgccctattgtagaaggaacttaccagtgtcagagcggaccttgcttccacagtttcactttggtgaacgttaccggcagcagcacagccgctccagaaacatctaaccttctttctgatactaacaaacctcgtgtcggaggtgagctttgggttccatctctaacagagggtgggagttctattgaagtggttgggtatttgattttaggggtggtcattggtgggtgcatagcagtgctgtatcaacttccttgctgggtcgaaatcagggtatttatctgctgggtcagacattgtggggaggaaccatgaaggggctcttgctgattatcctttccctggtggggggtgtgctgtcatgccacgaacagccacgatgtaacattaccacaggcaatgagaggaacgactgctctgtagttatcaaatgcgagcaccattgtcctctcaacatcacattcaagaataagaccatgggaaatgtatgggtgggattctggcaaccaggagatgagcagaactacacggtcactgtccatggtagcgatggcaatcacactttcggtttcaaattcatttttgaagtcatgtgtgatatcacactacatgtggctagacttcatggcttgtggccccctaccaaggagaacatggtgggtttttctttggcttttgtgatcatggcctgcttgatgtcaggtctgctggtaggggctctagtgtggtttctgaaacgcaagcccaggtacggaaatgaggagaaggaaaaattgctataaattctttttctcttcgcacaaccatgaatacagtgttccgtatcgtgctgctctctcttcttgtagctttcggtcaggcaggaattcatattattaatgctacatggtgggataatataactttagtgggaccctcagatactccagttacctggtatgatggcaagggattgcaattttgtgacggaagtacagttaagaatccgcagatcagacatacttgtaatgatcaaaacttaactctgattcatgttaacaaaacccatgaaagaacatacatgggttacagacatgacagtaagggaaaagtagactataaggttacagtcattccacctcctcctgctactgtaaagccacaaccagatccagaaaatgtctttgtttatatgggaaataatgtaactttagttggacctccaggaattccagttagttggtattatcataatggcacacagttctgcgatggagataaaattattcatccagaattcaaccacacctgtgataaacaaaaccttacactgctgtttgtaaactttacacatgatggaggctatcttggattcaattacaaaggtactcagagaattcagtatgaggttatagttttagatcgatttccaaattctggtcagatgaaaattgaagaacaaagtgaggaaacagaacagaaacatactgagcataataaggctggacaaaagcagggtatagatacaaatcaaaagaaagctaataacagacaaaagccatctcaaaggccatcaagaagacggccgacaaacactcctgagacaaaacaacttacagtgtctattgggtctaacttaactttagttggtccagatggaaaagtcacttggtatgatggtgatttaaaaagaccatgtgaagaacaaaactataggcttccacatcagtgtagtgctcagaacttaactttaattaatgtaactaaatctcatgagggaacttactatggcactaatgacaaagacgaaagcaaaagatacagagtgaaagtgaacactacaaattctcaagctgtaaaaattaacccatataccagacctactactcctgatcagaaacacagatttgaattacaaattgaaaataatgcaaatgatgaagaatcaaaaattccatctactactgtggcaatcgtggtgggagtgattgcgggcttcataactataatcattgtcattctgtgctacatctgctgccgcaagcgtcccagggcatacaatcatatggtagacccactactcagcttctcttactgagactcagtcactttcatttcagaaccatgaaggctttcacagcttgcgttctgtttaacataatcacacttagtgtagctgcaaatggttttaaacatgttaatgttaccagattaagtaatgtaacactgacaggagctggaattaatactacatggacagggtattttaatgagggtccaaaaggaaaaaatgggtggatgaatatttgcacatggggcgatcctagatatgtgtgccatggaaatagcagtactattactaatcttacagttgtggcacttctaaatttaaccactaacagaagatttaaagcagaaagttttactagtaacgatggttatgaaactaccagtgcaaaattttatgaaattaaaattattgagcttccaacaactagagcacccaccacagttaggacaacacagcctaccactgtgcccactacacatccaaccaccacagtcagtacaactattgagaccactactcatactacacagctagacacaacagtgcagaatactactttattgattgggtttttactgagaggaaatgaaagtactactgaacagacagaggctacctcaagtgccttcagcagcactgcaaatttaacttcgcttgcttggactaatgaaaccggagtatcattgatgaatcgacagccttactcaggtttggatattcaaattacttttctggttgtctgtgggatctttattcttgcggttcttctgtactttgtctgctgcaaagccagagagaaatctaggcggcccatatacaggccagtaatcggggaacctcagcctctccaagtggatggaggcttaaggaatcttctcttctcttttacagtatggtgatcagccatgattcctaggttcttcctatttaacatcctgttctgtctcttcaacatctgtgctgccttcgcggccgtctcgcacgcctcgcccgactgtctagggcctttcccaacatacctcctctttgccctgctaacctgcacctgcgtctgcagcattgtctgcgtggtcatcacctttctgcagctcatcgactggtgctgcgcgcgctacaattatctccaccacagtcccgaatacagggacgagaacgtagccagaatcttaaggctcatctgaccatgcagcctctgctcatgctgatatccctcctatcccctgcccttgccacttctgctgattactctaaatgcaaattcgcggacatatggaatttcttagattgctatcaggagaaaattgatatgccctcctattacttggtgattgttggggtagtcatggtctgctcatgcactttctttgccattatgatctacccctgttttaatcttggctggaactctgttgaggcattcacatacacactagaaaacagttcactagcctccacgccaccacccacaccgcctccccgcagaaatcagttccctatgattcagtacttagaagagccccctccccggcccccttccactgttagctactttcacataaccggcggcgatgactgaccacctggacctcgagatggacggccaggcctccgagcagcgcatcctgcaactgcgcgtccgacagcagcaggagcgggccgccaaggagctcctcgatgccatcaacatccaccagtgcaagaagggcatcttctgcctggtcaagcaggcaaagatcacctacgagctcgtgtccggcggcaagcagcatcgcctcgcctatgagctaccccagcagaagcaaaagttcacctgcatggtgggcgtcaaccccatagtcatcacccagcagtcgggcgagaccaacggctgcatccactgctcctgcgaaagccccgagtgcatctactccctcctcaagaccctttgcggactccgcgacctcctccccatgaactgatgttgattaaaagcccaaaaaccaatcaaacccttccccaattactcataagaataaatcattggaactaatcattcaataaagatcacttacttgaaatctgaaagtatgtctctggtgtagttgttcagcagcacctcggaaccctcctcccagctctggtactccagtccccggcgggcggcgaacttcctccacaccttgaaagggatgtcaaattcctggtccacaattttcattgtcttccctcagatgacaaagaggctccgggtggaagatgacttcaaccccgtctacccctatggctacgcgcggaatcagaatatccccttccttactcccccctttgtttcttccgatggattccaaaacttcccacctggggtcctgtcactcaaactggctgacccaatcgccatcactaatggggatgtttcactcaaggtgggagggggtcttactgttgaaaaagatagtggaaatctaaaggtgaaccctaaggctcccttgcaagttacaactgataaacagttggaaattgcactggcttatccatttgaagtcagtaatggcaagcttggcataaaagcaggtcatggattgaaagtcattgacaaaattgctggtttggaaggtttggcaggtacgcttgtagttttgactggaaaaggaataggtactgaaaatcttgaaaacagtgatgggtcaagtagaggagttggtataaacgtaagacttgctaaagatggaggtctgtcttttgataaaaagggtgatttagttgcttggaataaacatgatgacagacgcactctatggacaactcccgacccatccccaaattgtacaatcgatcaggaaagggattcaaagctcactttagtattaacaaaatgtggcagtcaaattttggctaatgtctctttacttgttgtaaaaggaaaatttagtaacataaacaataatactaatccaactgataaaaaaatcacagtaaagctactttttaatgaaaagggagtattaatggacagttcgacacttaagaaagaatattggaactacagaaatgataattctactgtatctcaggcctatgataatgcagttccttttatgccaaacataaaagcttatcctaaacctaccacagacacttcggctaaaccagaagataaaaaaagtgctgctaaaagatacattgtgagcaatgtctatattggaggcttgccagataaaactgttgttataactattaagtttaatgcagaaactgaatgtgcttattcgattacctttgaattcacatgggcaaaaacctttgaagatgtgcagtttgattcctcctcttttaccttttcctatattgcccaagaaaatgaggacgaagacaaataaaatgttttaaaatgaattcatgtatctttattgatttttacaccagcacgggtagtcagtctcccaccaccagcccatttcacagtgtaaacgattctctcagcacgggtggccttaaatagggaaatgttctgattagtgcgggaactggacttggggtctataatccacacagtttcctggcgagccaaacgggggtcggtgattgagatgaagccgtcctctgaaaagtcatccaagcgggcctcacagtccaaggtcacagtctggtgaaacgagaagaacgcacagattcatactcggaaaacaggatgggtctgtgcctctccatcagcgccctcaacagtctctgccgccggggctcggtgcggctgctgcagatgggatcgggatcacaagtctctctgactatgatccccacagccttcagcatcagtctcctggtgcgtcgggcacagcaccgcatcctgatctcgctcatgttctcacagtaagtgcagcacataatcaccatgttattcagcagcccataattcagggtgctccagccaaaactcatgttggggatgatggaacccacgtgaccatcgtaccagatgcggcagtatatcagatgcctgcccctcatgaacacactgcccatatacatgatctctttgggcatgtctctgttcacaatctgacggtaccagggaaagcgctggttgaacatgcacccgtaaatgactctcctgaaccacacggccagcagggtgcctcccgcccgacactgcagggagcccggggatgaacagtggcaatgcaggatccagcgctcgtacccgctcaccatctgagctctcaccaagtccagggtagcggggcacaggcacactgacatacatctttttaaaatttttatttcctctggagtcaagatcatatcccaggggactggaaactcttggagcagggtaaagccagcagcacatggtaatccacggacagaacttacattatgataatctgcatgatcacaatcaggcaacaggggatgttgttcagtcagtgaagccctggtttcctcatcagatcgtggtaaacgggccctgcgatatggatgatggcggagcgagctggattgaatctcggtttgcattgtagtggattctcttgcgtaccttgtcgtacttctgccagcagaaatgggcccttgaacagcagatacccctcctgcggccgtcctttcgctgctgccgctcagtcatccaactgaagtacatccattctcgaagattctggagaagttcctctgcatctgatgaaacaaaaaacccgtccatgcgaattcccctcatcacatcagccaggactctgtaggccatccccatccagttaatgctgccttgtctatcattcagagggggcggtggcaggattggaagaaccatttttattccaaacggtctcgaaggacgataaagtgcaagtcacgcaggtgacagcgttcccctccgctgtgctggtggaaacagacagccaggtcaaaacccactctattttcaaggtgctcgaccgtggcttcgagcagtggctctacgcgtacatccagcataagaatcacattaaaggctggccctccatcgatttcatcaatcatcaggttacattcctgcaccatccccaggtaattctcatttttccagccttggattatctctacaaattgttggtgtaagtccactccgcacatgtggaaaagctcccacagtgccccctccactttcataatcaggcagaccttcataatagaaacagatcctgctgctccaccacctgcagcgtgttcaaaacaacaagattcaataaggttctgccctccgccctgagctcgcgcctcaatgtcagctgcaaaaaatcacttaagtcctgggccactacagctgacaattcagagccagggctaagcgtgggactggcaagcgtaagggaaaactttaatgctccaaagctagcacccaaaaactgcatgctggaataagctctctttgtgtctccggtgatgccttccaaaatgtgagtgataaagcgtggtagtttttctttaatcatttgcgtaatagaaaagtcctgtaaataagtcactaggaccccagggaccacaatgtggtagcttacaccgcgtcgctgaagcatggttagtagagatgagagtctgaaaaacagaaagcatgcactaaactaaggtggctattttcactgaaggaaaaatcactctctccaacaacagggtacccactgggtggcccttgcggacatacaaaaatcggtccgtgtgattaaaaagcagcacagtaagttcctgtcttcttccggcaaaaatcacatcggactgggttagtatgtccctggcatggtagtcattcaaggccataaatctgccctgatatccagtaggaaccagcacactcacttttaggtgaagcaataccaccccatgcggaggaatgtggaaagattcagggcaaaaaaaattatatctattgctagtcccttcctggacgggagcaatccctccaggactatctatgaaagcatacagagattcagccatagctcagcccgcttaccagtagacagagagcacagcagtacaagcgccaacagcagcgactgactacccactgacccagctccctatttaaaggcgccttacactgacgtaatgaccaaaggtctaaaaaccccgccaaaaaaaaacacacacgccctgggtgttttttgcgaaaacacttccgcgttctcacttcctcgtattgatttcgtgacttaacttccgggttcccacgttacgtcacttctgcccttacatgtaactcagtcgtagggcgccatcttgcccacgtccaaaatggcttccatgtccagccacgcctccgcggcgaccgttagccgtgcgtcgtgacgtcatttgcatcatcttctctcgtccaatcagcgctggccccgccctaaattcaaaagctcatttgcatgttaacttttgtttactttgtggggtatattattgatgatgtttttctcagactctgggagcggagctcagagaaatctctactcgctggcactcaagagtggcctcttgacgggctcgactggtttaaataccctgtggatcagctgatctgtgacataaacaccggactttgacacggacgcggaaattcgcgaaaaaacaccgcaatcgaaacccccacgtaatcggtcaaagtctctcggccctcggtaaatattccgccctgggcgggaccggtatttttcacttttcacttcctcattcagttttcgcgccaaaatgacctaattttacttgcatccgcccagaattacctcatatccgggcgtggccgcgggaaaatcggccgtttccgggtctaaagtccgcttttttatacgtcatcagccccgcgacttgcttccgggctaggccacgcctccgcggcgaccgttagccgtgcgtcgtgacgtcatttgcatcaacgtttctcggccaatcagcagtagccccgccctaaatttaaaacctcatttgcatattaacttttgtttactttgtggggtatattattgatgatg

SEQ ID NO: 25 - DNA, 35250 bp, Adenovirus D25
  MISC_FEATURE (1)..(35250): Complete Genome
catcatcaataatataccccacaaagtaaacaaaagttaatatgcaaatgaggttttaaatttagggcggggctactgctgattggccgagaaacgttgatgcaaatgacgtcacgacgcacggctaacggtcgccgcggaggcgtggcctaggccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtgtgagaaaaatgagacacctgcgtctcctgcctggaactgtgcccttggacatggccgcattattgctggatgactttgtgagtacagtattggaggatgaactgcaaccaactccgttcgagctggggcccacacttcaggacctctatgatctggaggtagatgcccaggaggacgacccgaacgaagaggctgtgaatttaatatttccagaatctctgattcttcaggctgacatagccagcgaagctgtacctacaccacttcatacaccgactctgtcacccatacctgaattggaagaggaggacgaactagacctccggtgttatgaggaaggttttcctcccagcgattcagaggacgaacggggtgagcagagtatggctataatctcagactatgcttgtgtggttgtggaagagcattttgtgttggacaatcctgaggtgcctgggcaaggctgtagatcctgccaatatcaccgggatcagaccggagaccaaaatgcttcctgtgctctgtgttacatgaaaatgagcttcagctttatttacagtaagtggagtgaatgtgagagaggctgagtgcttaacacatcactgtgtgatgcttgaacagctgtgctaagtgtggtttattttgttactaggtccggtgtcagaggatgagtcatcaccctcagaagaagaccacccgtctccccctgatctcacagatgacacgcccctgcaagtgatcagacccaccccagtcagactcagtggggagaggcgaatggctgttgacaaaatcgaggacttgttgcaggacatgggtggggatgaacctttagacctgagcttgaaacgccccaggaactaggcgcagctgtgctgagtcatgtgtaaataaagttgtacaataaaagtatatgtgacgcatgcaaggtgtggtttatgactcatgggcggggcttagtcctatataagtggcaacacctgggcactcgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataaagaggaatttgaaaatatttttgctgactgctctggcctgctagattctctgaatcttggccaccagtcccttttccaggaaagggtactccacagccttgatttttccagtccagggcgcactacagccggggttgcttttgtggtttttctggttgacaaatggagccaggacacccaactgagcaggggatacatcctggacttcgcagccatgcacctgtggagggcctggatcaggcagcggggacagagaatcttgaactactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagtgaagagggagaggagcgatgggggcaataccgggatgatgaccgagctgactgccagcctgatgaatcgcaagcgcccagagcgcattacctggcatgagctacagatggagtgcagggatgagataggcctgatgcaggataaatatggtctggagcagataaaaacccactggttaaacccagatgaggattgggaggaggccattaagaaatatgccaagatagccctgcgcccagattgcaagtacagggtgaccaagacggtgaatatcagacatgcctgctacatctcggggaacggggcagaggtggtcatcgataccctggacaaggccgccttcaggtgttgcatgatgggaatgagagccggagtgatgaatatgaattccatgatcttcatgaacatgaagttcaatggagagaagtttaatggagtgatgttcatggccaacagccacatgaccctgcatggctgtagtttcttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtttctaccgagggcaatgctagagtgagacattgctcttccctggagacgggctgcttctgcctggtgaagggtacagcctctctgaagcataatatggtgaagggatgcacggatgagcgcatgtacaacatgctgacctgcgactcgggagtctgtcatatcctgaaaaacatccatgtgacctcccaccccagaaagaagtggccagtgtttgagaataacctgctgatcaagtgccatatgcacctgggcgccagaaggggcaccttccagccgtaccagtgcaactttagtcagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccagaatgcaaccagtggccctggatgtgaccgaggagctgagaccagaccacctggtgatggcctgtaccgggaccgagttcagctccagtggggaggatacagattagaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccccgggttgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcaagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccgggggtcccagacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgttggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgctggcgcgcacgtagtcatacaactcgtgcgagggggccaagaaggcggggccgagattggtgcgctgcggctgctcggcgcggaagacgatctggcgaaagatggcatgcgagttggaggagatggtgggtcgttggaagatgttaaagtgggcgtggggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaaatccgagtcgtcgcagccgccgtgctcccagagctcgaaatcggtgcgcttctttgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcggggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatatcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccactggccccgtgactttgaacctgaaagacagttcaacagaatcaatttcggcgtcattgacggcggcctgacgcaggatctcttgcacgtcgcccgagttgtcctggtaggcgatctcggacatgaactgctcgatctcctcctcctggagatcgccgcggcccgcgcgctcgacggtggcggcgaggtcattcgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgtacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggccgggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcggtcgaaaaccccgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgatcaacatcttgcagagcatcgtagtgcaggagcgcagcttgagcctggccgagaaggtggcggcgatcaactactcggtgttgagcctgggcaagttttacgcgcgcaagatttacaagacgccgtacgtgcccatagacaaggaggtgaagatagacagcttttacatgcgcatggcgctcaaggtgctgacgctgagcgacgaccttggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggttccccagagcgaggtgtaccagtcgggcccggactactttttccagacgagccggcagggcctgcagacggtgaacctgagccaggctttcaagaacctgcgcgggctgtggggcgtgcaggcgcccgtgggcgaccggtcgacggtgagcagcttgctgacgcccaactcgcgactgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagccgcgcgctggggcagaacgacaccgacagtctgagggccaccctgaactttttgctgaccaatagacagcagaagatcccggcgcagtacgcactgtcggccgaggaggaaaggatcctgagatatgtgcagcagagcgtagggctatttctgatgcaggagggtgccacccccagtgccgcgctggacatgaccgcgcgcaacatggaacctagcatgtacgctgccaaccggccgttcatcaataagctgatggactacctgcaccgcgcggcggccatgaacacggactactttaccaacgccatattgaacccgcactggctcccgccgccggggttctacacgggcgagtacgacatgcccgaccccaacgacgggttcctgtgggacgacgtggacagcgcggtgttctcgccggcctttcaaaagcgccaggaggcgccgccgagcgagggcgcggtgggccgcagcccatttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccaaactggggcggcggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagacgattctgcacaccaacatgcccaatgtgaacgagtacatgttcaccagcaagtttaaggcgcgggtgatggtggctagaaagcacccagagaatgtagacaaaacagatttgagtcaggataagcttgaatatgaatggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtgaccaagctggtgatgccaggggtctacacctacgaggcctttcacccggacgtggtgctgctgccgggctgcggggtggacttcacagagagccgcctgagcaacctcctgggcattcgcaagaagcaacctttccaagagggcttcagaatcatgtatgaggatctagaagggggtaacatccccgctctcctggataccaaaaaatatctggatagcaagaaggaacttgaggatgctgccaaggaagctgcaaagcaacagggagatggtgctgtcactagaggcgatacccacctcactgtagctcaagaaaaagcagctgaaaaggagctagtgatcgtaccaattgaaaaggatgagagcaacagaagttacaacctgatcaaggacacccatgacaccatgtaccgaagctggtacctgtcctatacctacggggaccccgagaagggggtgcagtcgtggacgctgctcaccactccggacgtcacctgcggcgcggagcaagtctactggtcgctgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccactatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgtgtgctttccagtcgcaccttctaaaaaaatgtctattctcatctcgcccagcaataacaccggctggggtattactaggcccagcaccatgtacggaggagccaagaaacgctcccagcagcaccccgtccgcgtccgcggccactttcgcgctccctggggagcttacaagcgggggcggactcccgctgccgccgtgcgcaccaccgtcgacgacgtcatcgactcggtggtcgccgacgcgcgcaactacacccccgccccctccaccgtggacgcggtcatcgacagcgtggtggccgacgcgcgcgactatgccagacgcaagagccggcggcgacggatcgccaggcgccacaggagcacgcccgccatgcgcgccgcccgagctctgctgcgccgcgccagacgcacgggccgccgggccatgatgcgagccgcgcgccgcgccgccactgcaccccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgccaaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcagaccgacccctggctcccagcctccaccgccaccgcctccacttctaccgccgctacggccaccgagcctcccaggaggcgaagatggggcgccgccagccggctgatgcccaactacgtgttgcatccttccatcatcccgacgccgggctaccgcggcacccggtactacgccagccgcaggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaaacctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaagctcaaagaccagaacttccagcagaaggtggtggacggcctggcctcgggcattaacggggtggtggacatcgcgaaccaggccgtgcagcgcgagataaacagccgcctggacccgcgaccgcccacggtggtggagatggaagatgcaactcctccgccgcccaaaggcgagaagcggccgcggcccgacgcggaggagacgatcctgcaggtggacgagccgccctcgtacgaggaggccgtgaaggccggcatgcccaccacgcgcatcatcgcgccgctggccacgggtgtaatgaaacccgccacccttgacctgcctccaccacccacgcccgctccaccgaaggcagctccggtcgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccatcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagcctggcccccaagggcgctcccaattccagtcagtgggaagaaaaaaagagtggagccggaaatcaaaccgaaactcatacgtttggcgttgctcccatgggcggaactaacatcacaattagcggtttgcaaattggaactgaggaagaagatggaaatcctacaaaggagatttttgcagataaaacattccagcctgaacctcaaataggagaagaaaactggcaggacactgagaatttttatggcggtagagctcttaagaaagacaccaaaatgaaaccttgctatggctcttttgccagacctactaacgaaaagggaggtcaagctaagttaaaacttgacgcccaaggtcagtcaactaaagattatgacattgacctggctttctttgactcacctggaggaaatacaacagctggtggtcaagaagagcttaaagcagacattgtcatgtacactgagaatgcttatctggaaacaccagatacccatgtagtttacaagccaggaacctctgatgacagttctgccgccaacttggttcagcaatccatgcccaacagacccaactacattggcttcagagacaactttgtgggtctcatgtattacaacagcactggcaacatgggtgtgctggctggtcaggcctctcagttgaatgccgtggtcgacttacaagacagaaacaccgagctgtcttaccagctcttgctagattctctgggcgacagaaccaggtactttagcatgtggaactctgcggtggacagctatgatcccgacgtcaggatcattgaaaatcacggtgtggaagatgaacttccaaactattgcttcccattggatggctctggcactaattcagcttatcaaggtgttaaagttaaaaatggggaagatggtgatattgagagcgaatgggaaaaagacaccaatgtcgcagctcgtaaccaactgtgcaagggtaacatctttgccatggagatcaacctccaggccaacctgtggaagagttttctgtactcgaacgtggccctgtacctgcccgactcatacaagtacacgccggccaacgtcaagctgcccaccaacaccaacacctacgagtacatgaacggccgcgtggtagccccctcactggtggacgcctacgtcaacatcggcgcccgctggtcgctggaccccatggacaacgtcaaccccttcaaccaccaccgcaatgcgggcctgcgctaccgctccatgcttctgggcaacggccgctacgtgcccttccacatccaagtgccccaaaagttctttgccatcaagaacctgctcctgctccccggctcctacacctacgagtggaacttccgcaaggacgtcaacatgatcctgcagagttccctcggaaacgacctgcgcgtcgacggcgcctccgtccgcttcgacagcatcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaggaaactccctccctcggctcgggtttcgacccctactttgtctactcgggctccatcccctacctcgacgggaccttctacctcaaccacaccttcaagaaggtttccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcacccaccatgcgtcaggggcagccctaccccgccaacttcccctacccgctcatcggctccaccgcagtcccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgactttcgaggtggaccccatggatgagcccaccctcctctatcttctcttcgaagttttcgacgtggtcagagtgcaccagccgcaccgcggcgtcatcgaggccgtctacctgcgcacacccttctccgccggcaacgccaccacctaagcatgagcggctccagcgaacgagagctcgcggccatcgtgcgcgacctgggctgcgggccctactttttgggcacccacgacaagcgcttcccgggcttcctcgccggcgacaagctggcctgtgccatcgtcaacacggccggccgcgagaccggaggcgtgcactggctcgccttcggctggaacccgcgctcgcgcacctgctacatgttcgacccatttgggttctcggaccgccggctcaagcagatttacagcttcgagtacgaggctatgctgcgccgcagtgccctggcttcctcgcccgaccgctgtctcagcctcgaacagtccacccagaccgtgcaggggcccgactccgccgcctgcggacttttctgttgcatgttcttgcatgccttcgtgcactggcccgaccgacccatggacggaaaccccaccatgaacttgcttacgggggtgcccaacggcatgctacaatcgccacaggtgctgcccaccctccggcgaaaccaggaggaactctaccgcttcctcgcgcgccactccccttactttcgatcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggaacttgggctgccacttgaactcggggatcaccagtttgggaaccggaatctcggggaaggtctcgctccacatgcgccggctcatctgcagggcgcccaatatgtcaggcgcggatatcttgaaatcgcagttgggaccggtgctctgcgcgcgcgagttgcggtacacggggttgcagcactggaacaccatcagactggggtgcttcacactggccagcacgctcttgtcgctgatctgatccttgtccaggtcctcggcgttgctcaggccgaacggggtcatcttgcacagctggcggcccaagaagggcacgctctgaggcttgtggttacactcgcagtgaacgggcattagcatcatccccgcgccgcgctgcatattcgggtagagggccttgacaaatgccgagatctgcttgaaagcttgctgggccttggccccctcgctgaaaaacagcccgcagctcttcccgctgaactggttattcccgcaaccggcatcatgcacgcagcagcgcgcgtcatggctggtcagttgcaccacgctccgtccccagcggttctgggtcaccttggccttgctgggctgctccttcaacgcgcgctgcccgttctcgctggtcacatccatctccaccacgtgatccttgtggatcatcaccgttccatgcagacacttgagctggccttccacctcggtgcagccgtgatcccacagggcgcagccggtgcactcccagttcttgtgcgcaatcccgctgtggctgaagatgtaaccttgcaacatgcggcccatgatggtgctaaatgctttctgggtggtgaaggtcagttgcagaccgcgggcctcctcgttcatccaggtctggcacatcttttggaagatctcggtctgttcgggcatgagcttgtaagcatcgcgcaggccgctgtcgacgcggtagcgttccatcagcacgttcatggtatccatgcccttctcccaggacgagaccagaggcagactcagggggttgcgcacgttcaggacaccgggggtcgcgggctcgacgatgcgttttccgtccttgccttccttcaacagaaccggcggctggctgaatcccactcccacgatcacggcttcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggcggcgaggggctcctctcctgctccggcggatagcgcgctgaaccgtggccccggggcggagtggcctctcggtccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaaccttttctcgccgcgcgtgccccccaaacgccagcccaacggcacctgcgagcccaacccgcgtctcaacttctatcccgtctttgcggtccccgaggcccttgccacctatcacatctttttcaagaaccaaaagatcccagtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgttgagctcacccacttcgcctaccccgccgtcaacctcccgcccaaggtcatgcgtcgcatcatggatcagctcatcatgccccacatcgaggccctcgatgagacccaagagcagcgcccagaggacgcccggcctgtggtcagcgacgagcagctcgcgcgctggctcgggacccgcgacctccagaccctggagcagcggcgcaagctgatgctggccgtggtcctggtcaccctcgagctcgaatgcatgcgccgcttcttcagcgaccccgagaccctgcgcaaggtcgaggagaccctgcactacactttcaggcacggcttcgtcaggcaggcctgcaagatctccaacgtggagctgaccaacctggtctcctgcctggggatcctgcatgagaaccgccttgggcagaccgtgctccactctaccctgaagggcgaggcgcggcgggactatgtccgcgactgcatctttctatttctctgccacacatggcaagcagccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgaggcagacgctgaaaggcgggctgcccgactttatgagccagagcatgttgcaaaactaccgcactttcattctcgagcgatcggggatcctacccgccacctgcaacgccttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctcctaagcgagacccaggtcatcggtaccttcgagctgcaaggtccggagaagtccaccgctccgctgaaactcacgccggggttgtggacttccgcgtacctgcgcaaatttgtacccgaggactaccacgcccacgagataaagttcttcgaggaccaatcgcgccctcagcacgcggatctcacggcctgcgtcatcacccagggcgcgatcctcgcccaattgcacgccatccaaaaatcccgccaagagtttcttctgaaaaagggtagaggggtctaccttgacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagaggagtcgccggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacttcatcgccaccatgagcaaggagattcccaccccttacatgtggagctatcagccccagatgggcctggccgcgggcgcctcccaggactactccacccgcatgaactggctcagtgccggcccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctaaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggttgacggctacgactgaatgtcctatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctgatcaggttcttcacccagcaacccttcctggtcgagcgggaccggggcgccaccacctacaccgtctactgcatctgtcctaccccgaagttgcatgagaatttttgctgtactctttgtggtgagtttaataaaagctaaactcttgcaatactctggaccttgtcgtcgtcaactcaacaagaccttcaacctcaccaaccagactgaggtaaaactcaactgcagaccaggggacaaatacatcctctggctctttgagaacacttccttcgcagcctccaacacctgtgccaacgacggtattgaaatacccaacaaccttaccagtggactgacttacaccaccagaaagactaagctagtgctctacaatccttttgtagagggaacctaccactgccagagcggaccttgctaccacactttcactttggtgaacgttaccggcagcagcacagccgctccagaaacatctaaccttctttttgatactaacactcctaaaaccggaggtgagctctgggttccctctctgacagaggggggtaaacatattgaagcggttgggtatttgattttaggggtggtcctgggtgggtgcatagcggtgctgtattaccttccttgctggatcgaaatcaaaatctttatctgctgggtcagacattgttgggaggaaccatgaaggggctcttgctaattatcctttccctggttgggggtgtactgtcatgccacgaacagccacgatgtaacatcaccacaggcaatgagaggagtgtgatatgcacagtagtcatcaaatgcgagcatacatgtcctctcaacatcacattcaagaataagaccatgggaaatgcatgggtgggcgattgggaaccaggagatgagcagaactacacggtcactgtccatggtagcaatggaaatcacactttcggtttcaaattcatttttgaagtcatgtgtgatatcacactgcatgtggctagacttcatggcttgtggccccctaccaaggagaacatggttgggttttctttggcttttgtgatcatggcctgtgcaatgtcaggtctgctggtaggggctataatatggttcctgaggcacaagcccaggtatggaaatctggaaaaggaaaaattgctataatgtttttctttccacagcatcatgaatacagtgatccgtatcgtgctgctctctcttcttgtagcttttagtcaggcaggatttcatactatcaatgctacatggtgggctaatataactttagtggggccctcagatacgccagtcacctggtatgataaacagggaatgcagttctgtgatggaaatacagttaagaatcctcaaataagacatgagtgtaatgagcaaaaccttacactaattcatgtgaacaaaacccatgaaaggacatacatgggttataatagacagagtactcataaggaagactataaagtcatagttataccgcctcctcctgctactgtaaagccacagtcaggtccagagtatgtatatgttaatatgggagagaacaaaaccttagttggacctccaggaataccagttacttggtatgacggagaaggaaataaattctgcgatggagaaaaagttgaacatgcagaatttaatcatacatgtgatgtgcaaaatcttacactgttgtttataaatcttacacatgatggggcttatcttggctataatcaccagggaactaaaagaacttggtatgaggttgtagtgacagatggttttccaaaatcaggggagatgaaaatcgaagatcagagtagacaaacagaacaaaaacaaactgggcaaaaacaaaatgagcataaacagggtgggcagaaacaggaggggcaaaaagagacaagtcaaaagaaagctagtgacaaacagaaggcgacacacaggaggccatcaaaactaaagccgcacacacctgaagcaaaactgattacagtttgtagtgggtctaacttaacattacttgggccagatggaaaggtcacttggtatgatgatgatttaaaaagaccatgcgagcctgggtataagttagagtgtaagtgtgacaatcaaaacctaacactaatcaatgtaactaaactttatgagggagtttactatggtactaatgacagaggcaacagcaaaagatacagagtaaaattaaacactactaattctcaaagtgtgaaaattcagccgtacaacagacctactactcctgatcagaaacacagatttgaattgcaaattgattctaatcaagacaatgacaaaattccatcaaccactgtggcaatcgtggtgggagtgattgcgggcttcataactataatcattgtcattctgtgctacatctgctgccgcaagcgtcccagggcatacaatcatatggtagacccactactcagcttctcttactgagactcagtcactttcatttcagaaccatgaaggctttcacagcttgcgttctgattagcatagtcacattagtatcagctgattacaaacaagttcaagttagcagaggaggaaatattacattagatggaccattcgataatactacatggacaagatatcataatgatggacataaaaatggttggatgaaaatttgcacatggactggagcaacatataaatgtcacaataatggaagcattactatttttgctttcaacattacatccggagtttacaaagcagaagggtataaaaaagaagttagaacattttcatctagaaatcaaaaacatacaattgaagattctggagattatgaacaacaaaaaatatatctatataatctaacaataattgaaccgccaactactaaagcacccaccacagttagaacaaccacgcagacaactactagggaaacaacacagcctactactgtacccactacacatccaaccaccacagtcagtacaactactgacaccacaactcacactacacatctagacactacagtgcagaatactactttattgattgggtttttactaagaggaaatgaaagtactactgatcagacagaggctacctcaagtgccttcagcagcactgcaaatttaacttcgcttgcttcggtaaatgagacgatcgtgccgatgatgtatggccaacattacccaggtttggatatacaaattactttcctgattgtctgtggggtctttatcctcgctgtccttctctactttgtctgctgcaaggccagagaaaaatctaggcggcccatctacaggccagtaatcggggaacctcagccactccaagtggatggaggcttaaggaatcttctcttctcttttacagtatggtgatcagccatgattcctaggttcttcctatttaacatcctcttctgtctcttcaacatctgcgctgccttcgcggccgtctcgcacgcctcacccgactgtctcgggcccttccccacctacctcctctttgccctgctcacctgcacctgcgtctgcagcattgtctgcctggtcatcaccttcctgcagctcatcgactggtgctgcgcgcgctacaattacctgcatcacagtcccgaatacagggacgagaacgtagccagaatcttaaggctcatatgaccatgcagactgtgctcatactgctatcactcctatcccatgccctcgctactgctgattactctaaatgcaaattcgcggacatatggaatttcttagactgctatcaggagaaaatggatatgccttcctattacttggtgattgttggggtagtcatggtctgctcctgcactttctttgccatcatgatctacccctgttttgatctcggctggaattctgttgaggcattcacatacacactagaaagcagttcactagcctccacgccaccacccacaccgcctccccgcagaaatcagtttcccatgattcagtacttagaagagccccctccccgacccccttccactgttagctactttcacataaccggcggcgatgactgaccacttggacctcgagatggacggccaggcctccgagcagcgcaccctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcatcaaccccatagtcatcacccagcagtcgggcgaggccagcggctgcatccactgctcctgcgaaagccccgagtgcatctactccctactcaagaccctttgcggactccgcgaccttctccccatgaactgatgttgattaaaagcccagaaaccaatcagccccttaccccattcccctcccacaattactcataagaataaatcattggaattaatgtttcaataaagatcacttacttgaaatctgaaagtatgtctctggtgtagttgttcagcaacacctcagtaccctcctcccagctctggtactcaagtccccggcgggcggcaaactttctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcccccctttgtctcctccgatggattccaaaactttccccctggtgtgctgtcactcaaattggctgacccaatcactatcagtaatggcgatgtctcactcaaggtgggagggggactcactgtggaacaagatagtggaaacctaagtgtgaaccctaaggctccattgcaagttggaacagacaaaaaactggaattggctttagcacctccatttaatgttaaagataacaagctagatctgctagtaggagatggattaaaggtaatagataaatcaatatctgaattgccaggattgttaaactatcttgtagttttgactggcaaaggaattggaaatgaagaattaaaaaatgacgatggtagcaataaaggagtcggtttatgtgtgagaattggagaaggaggtggtttaacttttgatgataaaggttatttagtagcatggaacaagaaacatgacatccgcacactttggacaactttagacccttctccaaattgtagaattgatgtggacaaggactctaaactaacattggtccttacaaagtgcggaagtcagatattggctaatgtatctcttcttgttgtcaaaggaaggtttcaaaacctaaattacaaaacaaacccaaaccttcctaaaacatttacaataaaattactgtttgatgaaaatgggattcttaaagactcatcaaatcttgacaagaactattggaactatagaaacggaaattctattttagcagagcaatataaaaatgcagttggctttatgccaaatttagcagcttatcccaaatctaccaccactcagtctaaactttatgcaagaaacactatttttggaaatatttacctagattcgcaagcatataatccagtggttattaaaattacttttaatcaagaagcagatagtgcttattctatcactttaaactattcatggggtaaggattatgaaaatatcccttttgattctacttcttttaccttttcctatatcgcccaagaatgaaagaccaataaacgtgtttttcatttgaaaattttcatgtatctttattgatttttacaccagcacgggtagttagtctcccaccaccagcccatttcacagtgtacacggttctttcagcacgggtggccttaaatagggaaatgttctgattagtgcgggaacttgacttggggtctataatccacacagtttcctggcgagccaaacgggggtcggtgattgagatgaagccgtcctctgaaaagtcatccaagcgggcctcacagtccaaggtcacagtctggtggaatgagaagaacgcacagattcatactcggaaaacaggatgggtctgtgcctctccatcagcgccctcaacagtctctgccgccggggctcggtgcggctgctgcagatgggatcgggatcgcaagtctctctgactatgatccccacagccttcagcatcagtctcctggtgcgtcgggcacagcaccgcatcctgatctctgccatgttctcacagtaagtgcagcacataatcaccatgttattcagcagcccataattcagggcgctccagccaaagctcatgttggggattattgaacccacgtgaccatcgtaccagatgcggcagtatatcaggtgcctgcccctcatgaacacactgcccatatacatgatctctttgggcatgtttctgttcacaatctggcggtaccatgggaatcgctggttgaacatgcacccgtaaatgactctcctgaaccacacggccagcagggtgcctcccgcccgacactgcagggagcccggggatgaacagtggcaatgcaggatccagcgctcgtacccgctcaccatctgagctctcaccaagtccagggtagcggggcacaggcacactgacatacatctttttaaaatttttatttcctctggggtcaggatcatatcccaggggactggaaactcttggagcagggtaaatccagcagcacatggtaatccacggacagaacttacattatgataatctgcatgatcacaatcgggcaacagggggtgttgttcagttagtgaggccctagtctcctcctcacatcgtggtaaacgggccctgcggtaaggatgatggcggagcgagctcgactgttcctcggtggacattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgaccaatcagcgacgaccccaccctaaattcaaaagctcatttgcatattaacttttgtttactttgtggggtatattattgatgatg

SEQ ID NO: 26 - DNA, 35132 bp, Adenovirus D26
  MISC_FEATURE (1)..(35132): Complete Genome
catcatcaataatataccccacaaagtaaacaaaagttaatatgcaaatgaggttttaaatttagggcggggctactgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgatccgcagggtatttaaaccagtcgagtccgtcaagaggccactcttgagtgccagcgagtagagatttctctgagctccgctcccagagaccgagaaaaatgagacacctgcgcctcctgccttcaactgtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaggaggctgtgaatttaatatttccagaatctatgattcttcaggctgacatagccaacgaatctactccacttcatacaccgactctgtcacccatacctgaattggaagaggaggacgaactagacctccggtgttatgaggaaggttttcctcccagcgattcagaggatgaacggggtgagcagaccatggctctgatctcagactatgcttgtgtgattgtggaggaacaagtagtgattgaaaattctaccgagccagtggagggctgtagaaaatgccagtaccaccgggataagtctggagacccgaacgcatcatgcgctttgtgctatatgaaacagactttcagctttatttacagtaagtggagtgaatgtgagagaggctgagtgcttaacacatcactgtgtattgcttgaacagctgtgctaagtgtggtttatttttgtttctaggtccggtgtcagaggatgagtcatcaccctcagaagaagaccacccgtctccccctgatctcacagatgacacgcccctgcaagtgcacagacccaccccagtcagagccagtggcgagaggcgagcagctgttgaaaaaattgaggacttgttacatgacatgggtggggatgaacctttggacctgagcttgaaacgccccaggaactaggcgcagctgcgcttagtcatgtgtaaataaagttgtacaataaaagtatatgtgacgcatgcaaggtgtggtttatgactcatgggcggggcttagtcctatataagtggcaacacctgggcactgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataaagaggaatttgaaaatatttttgctgactgctctggcctgctagattctctgaatcttggccaccagtcccttttccaggaaagggtactccacagccttgatttttccagcccagggcgcactacagccggggttgcttttgtggtttttctggttgacaaatggagccaggacacccaactgagcaggggctacatcctggacttcgcagccatgcacctgtggagggcctggatcaggcagcggggacagagaatcttgaattactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagttaagagggagaggagcgatgggggtaataccgggatgatgaccgagctgacggccagcctgatgaatcggaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttcttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacctgcgattcgggggtctgccatatcctgaagaacatccatgtgacctcccaccccagaaagaagtggccagtgtttgagaataacctgctgatcaagtgccatatgcacctgggagccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggatacagattagaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgaggggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagcggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcttacaagcgcgggcggacttccaccgccgccgtgcgcaccaccgtcgacgacgtcatcgactcggtggtcgccgacgcgcgcaactacactcccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaattcgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaaaggcgaaaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatcccagtcagtgggaaacaaaagaaaagcaaggaactactggaggagtgcagcaagaaaaagatgtcacaaaaacatttggtgtggctgccaccggcggaattaatataacaaaccagggtctgttactaggaactgacgaaaccgctgagaatggcaaaaaagacatttatgcagacaagactttccagccagaacctcaagttggagaagaaaactggcaggaaaatgaagccttctatggaggaagggctcttaaaaaggacactaaaatgaaaccatgctatggatcttttgctagacctactaatgagaaaggaggtcaggcaaagttcaaaccagttaatgaaggagaacaacctaaagatctggatatagattttgcttactttgacgtccctggcggaagtcctccagcaggtggtagtggggaagaatacaaagcagatataattttgtacactgaaaatgttaatcttgaaacaccagacactcatgtggtttacaagccaggaacttcagataacagttcagaaatcaatctggttcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattgaatggcactggaaccaattccacttatcaaggtgtaaagattacaaatggtaatgatggtgctgaagaaagtgagtgggagaaagacgatgcaatttctagacaaaaccaaatctgcaagggcaatgtctacgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggaccccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccacgacccccaggctttggaacagcggcgcaagctcatgctggccgtggtcctggttaccctcgagctggaatgcatgcgccgcttcttcagcgaccccgagaccctgcgcaaggtcgaggagaccctgcactacactttcagacacggtttcgtcaggcaggcctgcaagatctccaacgtggagctgaccaacctggtctcctgcctggggatcctgcacgagaaccgcctggggcagaccgtgctccactctaccctgaagggcgaggcgcggcgggactatgtccgcgactgcgtctttctatttctttgccacacatggcaagcagccatgggcgtgtggcaacagtgtctcgaggacgataacctgaaggagctggacaagcttcttgctagaaatcttaaaaagctgtggacgggcttcgacgagcgcaccgtcgcctcggacctggccgagatcgtgttccccgagcgcctgaggcagacgctgaaaggcgggctgcccgacttcatgagccagagcatgttgcaaaactaccgcactttcattctcgagcgatctgggatgctgcccgccacctgcaacgctttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctactaagcgagacccaggtcatcggtacctttgagctgcaaggtccgcaggagtccaccgctccgctgaaactcacgccggggttgtggacttccgcgtacctgcgcaaatttgtacccgaggactaccacgcccacgagataaagttcttcgaggaccaatcgcgtccgcagcacgcggatctcacggcctgcgtcatcacccagggcgcaatcctcgcccaattgcacgccatccaaaaatcccgccaagagtttcttctgaaaaagggtagaggggtctacctggacccccagacgggcgaagtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgcagctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtaaacatcccccgcaacgtgttgcattactaccgtcaccttcacagctaagaaaaagcaagtaaaaggagtcgccggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcaacgacggtgttgaacttcccaacaacctttccagtggactgagttacgatacacatagagctaagctcgtcctctacaatccttttgtagagggaacctaccagtgccagagcggaccttgtactcacaccttccatttggtgaacgtcaccagcagcagcaacagctcagaaactaaccttccttctgatactaacaaacctcgtttcggaggtgagctaaggcttcccccttctgaggagggggttagcccatacgaagtggtcgggtatttgattttaggggtggtcctgggtgggtgcatagcggtgctagctcagctgccttgctgggtggaaatcaaaatctttatatgctgggtcagatattgtggggaggaaccatgaaggggcttttgctgattatccttttcatggtggggggtgtactgtcatgccacgaacagccacgatgtaacatcaccacaggcaatcatatgagcagagagtgcactgtagtcatcaaatgcgagcacgactgcccactaaacattacattcaagaataacaccatgggaaatgtatgggtgggtttctgggaaccaggagatgagcagaactacacggtcactgtccatggtagcaatggaaatcacactttcggtttcaaattcatttttgaagtcatgtgtgatatcacactgcatgtggctagacttcatggcttgtggccccctaccaaggagaacatggttgggttttctttggcttttgtgatcatggcctgcttgatgtcaggtctgctggtaggggctttagtgtggttcctgaagcgcaagcctaggtacggaaatgaagaaaaggaaaaattgctataatctttttctttttcacagaaccatgaatgctttgaccagtgtcgtgctgctctctcttcttgtagcttttagtaatggggaagctgaaactgtagttgtaaatgttaaatctggtacaaaccacacccttgaaggtcctagaaaaactccagttcagtggtatgggggtgctaactttgacatgttttgcaatggctctaaaatacatcacaatgaattgaatcacacttgctctattcagaacataactcttacattcataaacagaacacatcatggaacatactatggttttggctctgacaatcaaaattcaaaagtgtatcatgtcagagtagatgtagagcctcctagaccccgtgctactttggctcctcctcaggacataactattaagtatggctcaaatagaacattgcagggcccaagtgttactccagttagttggtatgatggtgaaggaaatcggttttgcgatggcgataaaattgatcatacagaaattaatcacacttgcaatgctcaaaaccttactttgctgtttgtgaatgaaacacatgaaagaacatattatggaattagtggtgattggaaacagcgaaatgagtatgatgttactgttacaaagacacaattaaatattaaaaatttgggccaacgcaaaactgatgaaaaccataaaaatggaatgcatcagaaagtcgaacaaaatcctgaaactaagaaagaacagaagccttcaaaaagacctagacaaaaaacattgcaaactacaattcaggttatgattcctattggaactaattatactttagtggggccttcgccaccagtgagctggcatactacaaaaaatggcttaacagaactctgtaatggaaaccctattttaagacacacttgtgatgggcaaaatattacacttattaatgttaatgctacatttgaggctgattactatggctcgaacaataagagtgaatcaaaacactacagagtcaaggttttcaaagaaagaaaagatcaggcactattattcagaccgcttactaccaaaggaagcatgatcattactactgaaaatcaaaactttgaattacaacaaggtgacaatcaagatgatgacaaaattccatcaactactgtggcaatcgtggtgggtgtgattgcgggctttgtgactctgatcattgtcttcatatgctacatctgctgccgcaagcgtcccaggtcatacaatcatatggtagacccactactcagcttctcttactgaaactcagtcactctcatttcagaaccatgaaggctttcacagcttgcgttctgattagcatagtcacacttagtgcagctgaagctaaatgctttcatacttataacttaactagaggggaaaatattacattagcaggtgctggcttaaacacaacatgggaagcatatcacaatggatggaaacaagtttgtccatggaatgacggtcgctatgtgtgcgttggaaacagcagtaccataactaatcttacagttgtagctaatgcaaatttatcatcaactgttaaatttagagctgaaagtttatacattggaacagatggatatgaaagcaatccatcatgcttttatactatcaatgtaattgagcttccaaccaccagatcgccaactaccaccacggtcagtacaactactgagaccacaactcacactacacagttagacactacagtgcagaatagtactgtattggttaggtatttgttaagggaggaaagtactactgaacagacagaggctacctcaagcgccttcagcagcacttcaaatttaacttcgcttgcttggactaatgaaaccggagtatcattgatgcatggccagccttactcaggtttggatattcaaattacttttctggttgtctgtgggatctttattcttgtggttcttctgtactttgtctgctgcaaagccagagaaaaatctaggcggcccatctacaggccagtaatcggggaacctcagccactccaagtggatggaggcttaaggaatcttcttttctcttttacagtatggtgatcagccatgattcctaggttcttcctatttaacatcctcttctgtctcttcaacgtgtgcgctgccttcgcggccgtctcgcacgcctcacccgactgtctcgggcccttccccacctacctcctctttgccctgctcacctgcacctgcgtctgcagcattgtctgcctggtcatcaccttcctgcagctcatcgactggtgctgcgcgcgctacaattacctgcatcatagtcccgaatacagggacgagaacgtagccagaatcttaaggctcatatgaccatgcagactctgctcatactgctatccctcctatcccctaccctcgccacttctgctgattactctaaatgcaaattcgcggacatatggaatttcttagactgctatcaggagaaaattgacatgccctcctattacttggtgattgtgggaatagttatggtctgctcctgcactttctttgccatcatgatctacccctgttttgatctcggctggaactctgttgaagcattcacatacacactagaaagcagttcactagcctccacgccaccacccacaccgcctccccgcagaaatcagtttcccatgattcagtacttagaagagccccctccccgacccccttccactgttagctactttcacataaccggcggcgatgactgaccaccacctggacctcgagatggacggccaggcctccgagcagcgcatcctgcaactgcgcgtccgtcagcagcaggagcgtgccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctgctcaagaccctttgcggactccgcgacctcctccccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacaattctctcagcacgggtggccttaaatagggaaatgttctgattagtgcgggaactggacttggggtctataatccacacagtttcctggcgagccaaacgggggtcggtgattgagatgaagccgtcctctgaaaagtcatccaagcgggcctcacagtccaaggtcacagtctggtggaatgagaagaacgcacagattcatactcggaaaacaggatgggtctgtgcctctccatcagcgccctcaacagtctttgccgccggggctcggtgcggctgctgcagatgggatcgggatcgcaagtctctctgactatgatccccacagccttcagcaacagtctcctggtgcgtcgggcacagcaccgcatcctgatctctgccatgttctcacagtaagtgcagcacataatcaccatgttattcagcagcccataattcagggcgctccaaccaaagctcatgttggggatgatggaacccacgtgaccatcgtaccagatgcggcagtatatcaggtgcctgcccctcatgaacacactgcccatatacatgatctctttgggcatgtttctgttcacaatctgccggtaccatgggaatcgctggttgaacatgcacccgtaaatgactctcctgaaccacacggccagcatggtgcctcccgcccgacactgcagggatcccggggctgaacagtggcaatgcaggatccagcgctcgtacccgctcaccatctgagctctcaccaagtccagggtagcggggcacaggcacactgacatacatctttttaaaatttttatttcctctggggtcaggatcatatcccaggggactggaaactcttggagcagggtaaagccagcagcacatggtaatccacggacagaacttacattatgataatctgcatgatcacaatcgggcaacagggggtgttgttcagttagtgaggccctagtctcctcctcacatcgtggtaaacgggccctgcggtaaggatgatggcggagcgagctcgactgttcctcggtggacattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaacgtttctcggccaatcagcagtagccccgccctaaatttaaaacctcatttgcatattaacttttgtttactttgtggggtatattattgatgatg

SEQ ID NO: 27 - DNA, 35145 bp, Adenovirus D27
  MISC_FEATURE (1)..(35145): Complete Genome
catcatcaataatataccccacaaagtaaacaaaagttaatatgcaaatgagcttttgaattttaacggtttcggggcggagccaacgctgattggacgagagaagacgatgcaaatgacgtcacgacgcacggcgttaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgatccgcagggtatttaaaccagtcgagtccgtcaagaggccactcttgagtgccagcgagtagagatttctctgagctccgctcccagagaccgagaaaaatgagacacctgcgcctcctgccttcaactgtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaggaggctgtgaatttaatatttccagaatctatgattcttcaggctgacatagccaacgaatctactccacttcatacaccgactctgtcacccatacctgaattggaagaggaggacgaactagacctccggtgttatgaggaaggttttcctcccagcgattcagaggatgaacggggtgagcagaccatggctctgatctcagactatgcttgtgtgattgtggaggaacaagtagtgattgaaaattctaccgagccagtggagggctgtagaaaatgccagtaccaccgggataagtctggagacccgaacgcatcatgcgctttgtgctatatgaaacagactttcagctttatttacagtaagtggagtgaatgtgagagaggctgagtgcttaacacatcactgtgtattgcttgaacagctgtgctaagtgtggtttatttttgtttctaggtccggtgtcagaggatgagtcatcaccctcagaagaagaccacccgtctccccctgatctcacagatgacacgcccctgcaagtgcacagacccaccccagtcagagccagtggcgagaggcgagcagctgttgaaaaaattgaggacttgttacatgacatgggtggggatgaacctttggacctgagcttgaaacgccccaggaactaggcgcagctgcgcttagtcatgtgtaaataaagttgtacaataaaagtatatgtgacgcatgcaaggtgtggtttatgactcatgggcggggcttagtcctatataagtggcaacacctgggcactgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataaagaggaatttgaaaatatttttgctgactgctctggcctgctagattctctgaatcttggccaccagtcccttttccaggaaagggtactccacagccttgatttttccagcccagggcgcactacagccggggttgcttttgtggtttttctggttgacaaatggagccaggacacccaactgagcaggggctacatcctggacttcgcagccatgcacctgtggagggcctggatcaggcagcggggacagagaatcttgaattactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagttaagagggagaggagcgatgggggtaataccgggatgatgaccgagctgacggccagcctgatgaatcggaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttcttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacctgcgattcgggggtctgccatatcctgaagaacatccatgtgacctcccaccccagaaagaagtggccagtgtttgagaataacctgctgatcaagtgccatatgcacctgggagccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtcgagtgagtagtgggcgtggctaaggtgactataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggagctcgtcgctcgacagcaccgccgcagccgcggcagccgcagctgccatgacagcgacgagactggcctcgagctacatgcccagcagcggcagcagcccctctgtgcccagttccatcatcgccgaggagaaactgctggccctgctggccgagctggaagccctgagccgccagctggccgccctgacccagcaggtgtccgagctccgcgagcagcaacagcagcaaaataaatgattcaataaacacagattctgatccaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtctttgagaaggagactgatggccacggggagccccttggtgtaggtattggcgaagcggttgagctgggagggatgcatgcggggggagatgatgtgcagtttggcctggatcttgaggttggcgatgttgccacccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcattcatccatgatgatggcgatgggcccgtgggctgcggctttggcaaagacgtttctggggtcagatacatcataattatgctcctgggtgagatcatcataagacattttaatgaatttggggcggagggtgccagattgggggacgatggttccctcgggccccggggcgaagttcccctcacagatctgcatctcccaggctttcatctcggagggggggatcatgtccacctgcggggcgatgaaaaaaacggtttccggggctggggtgatgagctgcgaagagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccgaacgagctcgccgaggaggcggtccccgcccagcgagaggagctcttgcagggaagcaaagtttttcaggggcttgagtccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgggcccctggctgggcgcttgcaagggtgcgcttgagactcatcctgctggtgctgaaacgggcacggtcttcgccctgcgagtcggcgagatagcagttgaccatgagctcgtagttgagggcctcggcggcgtggcccttggcgcggagcttgcccttggaagagcgcccgcaggcgggacagaggagggattgcagggcgtagagcttgggggcgagaaagacggactcgggagcgaaagcgtccgctccgcagtgggcgcagacggtctcgcactcgacgagccaggtgagctctggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcctgccctgccgcgatgctttttaggagactttcatccatctggtcagaaaagacaatttttttattgtcaagcttggtggcgaaggagccatagagggcgttggagagaagcttggcgatggatctcattgtctgatttttgtcacggtcggcgcgctccttggccgcgatgttgagctggacatactcgcgcgcgacgcacttccattccgggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacggtggcagcacatcaagcagatgctcgtcaggggggtccgcatcgatggtgaagatgcccggacagagttccttgtcaaaataatctatttttgaggatgcatcatccaaggccatctgccactcgcgggcggccagcgctcgctcgtaggggttaaggggcggaccccagggcatgggatgcgtgagggcggaggcgtacatgccgcagatgtcatagacatagatgggctccgagaggatgccgatgtaggtgggataacagcgccccccgcggatgctggcgcgcacgtagtcatacaactcatgcgagggggccaagaaggcggggccgagattggtgcgctggggctgctcggcgcggaagacgatctggcgaaagatggcatgcgagttggaggagatggtgggccgttggaagatgttaaagtgggcgtggggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaaatccgagtcgtcgcagccgccgtgctcccagagctcgaaatcggtgcgcttctttgagagggggttaggcagagcgaaagtgacgtcattgaagagaatcttgcctgcccgcggcatgaaattgcgggtgatgcggaaagggcccgggacggaggctcggttgttgatcacctgggcggcaaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcgggttcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggctttcatgttcgcctgcgtgggactcaccctggggctcctcgaggacggagaggctgacgagcccgcgcgggagccaggtccagatatcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcggcccatgagctgcgagaaggcgcccaggccgctctcgttccagacgcggctgtagaccacgtccccgtcggcgtcgcgtgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcattgcgggccgagaccgtgagctcgtcttccaggagcctgatgagctcggcgatggtggcgcgcacctcgcgctcgaaatccccgggggcctcctcttcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcaatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcatccatgtcgacgaagcggtggtaggccccggtgttgatggtgtaggtgcagttggccatgagcgaccagttgacggtctgcaggccgggttgcacgacctcggagtacctgatccgcgagaaggcgcgcgagtcgaagacgtagtcgttgcaggtgcgcacgaggtactggtagccgactaggaagtgcggtggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgctggccgaggggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagacagagatggacttggaagagggcgaagggctggcaagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgaacagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcactgctgaacatcgccgagcccgagggtcgctggctgctggagctgatcaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctaagcgaccgcgagctgatgctgagccttcgccgggcgctggtagggggcgccgccggcggcgaggagtcctacttcgacatgggggcggacctgcattggcagccgagccggcgcgccttggaggccgcctacggtccagaggacttggatgaggatgaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcgaaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccggactactttttccagacgagccggcagggcttgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagccgcgcgctggggcagaacgacaccgacagtctgagggccaccctgaacttcttgctgaccaatagacagcagaagatcccggcgcagtacgcactgtcggccgaggaggaaaggatcctgagatatgtgcagcagagcgtagggctgttcctgatgcaggagggcgccacccccagcgccgcgctggacatgaccgcgcgcaacatggaacctagcatgtatgccgccaaccggccgttcatcaataagctgatggactacctgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacttttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccacgggccaagaacgccatggccaataacgggatagagagtctggtggacaaactgaaccgatggaagacctacgctcaggaccatagggacgcgcctgcgccgcggcgacagcgccacgaccggcaacggggcctggtgtgggacgacgaggactcggccgacgataacagcgtgttggacttgggcgggagcggtggggccaacccgttcgcgcatctgcagcccagactggggaggcggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcaccccagccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctaggaaggtggtagatcagaatgataggagcaaggatgagttaaaatatgagtggtttgagtttaccctgcccgagggcaacttttccgagaccatgaccatagacctgatgaacaacgccatcttggaaaactacttacaagtggggcgacagaatggcgtgctggagagcgatatcggagtcaagtttgacagtaggaatttcaagctgggctgggacccggtgaccaagctggtgatgccaggggtctacacctacgaggcctttcacccggacgtggtgctgctgcctggctgcggggtggacttcaccgagagccgcctgagcaaccttctgggcattcgcaagaagcaacctttccaagagggcttcaggatcatgtatgaggatctcgagggtggtaacatccccgccctcctggatgtcaagcaatatttggatagtaaaaagaagcttgaggaggcaacacaaaatgcaaccagggctgctggagatatcagaggagacagtcatattccaagagctgtggaacaagcggctgaaaaggatctggtcattgtaccagtaacacaagatgaaagcaaaagaagctataatgtcatagatggcacccatgacaccctgtaccgaagttggtacctgtcctatacctacggggaccccgagaagggggtgcagtcgtggacgctgctcaccaccccggacgttacctgcggcgcggagcaagtctactggtcgctgccggacctcatgcaagaccccgtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccctgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgtcatcgactcggtggtcgccgacgcgcgcaactacactcccgccccctccaccgtggacgcggtcatcgacagcgtggtggccgacgcgcgcgactatgccagacgcaagagccggcggcgacggatcgccaggcgccaccggagtacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgagagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatagaggtgcagaccgacccctggctcccagcctccaccgctaccgtctccacttctaccgccgccacggctaccgagcctcccaggaggcgaagatggggcgccgccagccggctgatgcccaactacgtgttgcatccttccattatcccaacgcctggctaccgcggcacccggtactacgccagccgcaggcacccagccaccaagcgccgccgccgcaccaccacccgccgccgtctggccccagcccgcgtgcgccgcgtgaccacgcgccggggccgctcgctcgttctgcccaccgtgcgctaccaccccagcatcctttaattcgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctctggcattaacggggtggtggacatcgcgaaccaggccgtgcagcgcgagataaacagccgcctggacccgcgcccgcccacggtggtggagatggaagatgcaactcttccgccgcccaaaggcgagaagcggccgcggcccgacgcggaggagacgatcctgcaggtggacgagccgccctcgtacgaggaggccgtgaaggccggcatgcccaccacgcgcatcatcgcgccgctggccacgggtgtaatgaaacccgccacccttgacctgcctccaccacccacgcccgctccaccaaaggcagctccggttgtgcagccccctcctgtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgctttgtgcccgtggatcgcgaggacaccacgtactcatacaaggcgcgcttcactctggccgtgggcgacaaccgggtgctagacatggccagcacgtactttgatatccgcggcgtcctggaccgcggtcccagcttcaaaccctactcgggcacggcttacaacagcctggctcccaagggcgcccccaactccagtcagtggactgctaaagaaaatcaaaaagatgttacaaaaacatttggtgtagctccaatgggaggaattaatatatcaaaggatggtttacaaattggcgttgaagaaacagttgacaagcaagaaaaggaaatttatgctgacaagagtttccagccagaacctcaagtaggagaagaaaactggcaagagtcagaagccttctatggcggcagagctcttaagaaggacaccaagatgaaaccatgctatggttcatttgccagacccactaatgaaaagggaggtcaggcaaaattcaaagcacctgctgtcgaaggagaacagcctaaggaacttgatattgactttgctttctttgacactgactcaggtgacacagaatataaagcagatattgttatgtatgctgaaaacgtgaatctggaaactccagacactcatgttgtttacaaaccaggcaaagaggatgatagctctgaagcaaacttggttcagcagtccatgccaaacagaccaaactacattggctttagagacaattttgtggggctcatgtattacaacagcactggtaacatgggtgtgctggctggtcaggcctctcagttgaatgctgtggtcgacttgcaagacagaaacacagagctgtcttaccagctattgctagattctctgggtgacagaaccaggtactttagcatgtggaactctgcggtggacagctatgatcccgatgtcaggatcattgaaaatcatggtgtggaagatgaacttccaaactattgcttcccattggatggctctggaactaattccacatatcaaggtgtaaaaattacagatggaaatggtgctttgcaaaacggatgggcaaaagatgatgcaatctcgagacaaaaccaaatctgcaagggcaacatctacgccatggagatcaacctccaggccaacctgtggaagagttttctgtactcgaacgtggccctgtacctgcccgactctttcaagtacacgccggccaacgtcactctgcccaccaacaccaacacctacgagtacatgaacggccgcgtggtggccccctcgctggtggacgcctacatcaacatcggcgcccgctggtcgctggaccccatggacaatgtcaaccccttcaaccaccaccgcaacgcgggcctgcgctaccgctccatgttgctaggcaacggccgctacgtgcccttccatatccaagtgccccaaaagttctttgccatcaagaacctgctcctactcccgggctcctacacctacgagtggaacttccgcaaggacgtcaacatgatcctgcagagttccctcggcaacgacctgcgcgtcgacggcgcctccgtgcgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcactcgcctgaaaaccaaggaaactccctcgctcggctcgggtttcgacccctactttgtctactcgggctccattccctacctcgacgggaccttctacctaaaccacaccttcaagaaggtctccatcatgttcgactcctcggtcagctggcccggcaacgaccggctgctcacgccgaacgagttcgaaatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtattccttcttccgcaacttccagcccatgagcaggcaggtggtcgatgagatcaactacaaggactacaaggccgtcaccctgcccttccagcacaacaactcgggcttcaccggctacctcgcacccaccatgcgtcaggggcagccctatcccgccaacttcccctacccgctcatcggctccaccgcagtgccctccgtcacccagaaaaagttcctctgcgacagggtcatgtggcgcatccccttctccagcaacttcatgtccatgggcgcccttaccgacctgggtcagaacatgctctacgccaactcggctcacgcgctcgacatgaccttcgaggtggaccccatggatgagcccaccctcctctatcttctctttgaagttttcgacgtggtcagagtgcaccagccgcaccgcggcgtcatcgaggccgtctacctgcgcacgcccttctccgccggcaacgccaccacctaagcatgagcggctccagcgaaagagagctcgcggccatcgtgcgcgacctgggctgcgggccctactttttgggtacccacgacaagcgcttcccgggcttccttgccggcgacaagctggcctgcgccatcgtcaacacggccggccgcgagaccgggggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctccggcgcaaccaggaggagctctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggaactggtacttgggctgccacttgaactcggggatcaccagtttgggcactggggtctcggggaaggtctcgctccacatgcgccggctcatctgcagggcgcccagcatgtcaggcgcggagatcttgaaatcgcagttggggccggtgctctgcgcgcgcgagttgcggtacactgggttgcagcactggaacaccatcagactggggtacttcacactagccagcacgctcttgtcgctgatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacgaaggccgcgatctgcttgaaagcttgctgggccttggccccctcgctgaaaaacaggccgcagctcttcccgctgaactgattattcccgcacccggcatcatggacgcagcagcgcgcgtcatggctggtcagttgcaccacgctccgtccccagcggttctgggtcaccttggccttgctgggttgctccttcagcgcgcgctgtccgttctcactggtcacatccatctccaccacgtggtccttgtggatcatcaccgttccatgcagacacttgagctggccttccacctcggtgcagccgtgatcccacagggcgcagccggtgcactcccaattcttgtgcgcgatcccgctgtggctgaaaatgtaaccttgcaacaggcgacccatgacggtgctaaatgctttctgggtggtgaaggtcagttgcagaccgcgggcctcctcgttcatccaggtctggcacatcttttggaagatctcggtctgctcgggcatgagcttgtaagcatcgcgcaggccgctgtcgacgcggtagcgttccatcagcacgttcatggtatccatgcccttctcccaggacgagaccagaggcagactcagggggttgcgcacgttcaggacaccgggggtcgcgggctcgacgatgcgttttccgtccttgccttccttcaacagaaccggcggctggctgaatcccactcccacgatcacggcttcttcctggggcatctcttcgtctgggtctaccttggtcacatgcttggtctttctggcttgcttcttttttggagggctgtccacggggaccacgtcctcctcggaagacccggatcccacccgctgatactttcggcgcttggttggcagaggaggtggcggcgaggggctcctctcctgctccggcggatagcgcgctgaaccgtggccccggggcggagtggcctctcggtccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctcaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacatgcgagcccaacccgcgtctcaacttctatcccgtctttgcggtccccgaggccctcgccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggtgacaacgccaggctggccgtgctcaagcgcagcgtcgagctcacccactttgcctaccccgccgtcaacctcccgcccaaggtcatgcgtcgcatcatggatcagctcatcatgccccacatcgaggccctcgatgagacccaagagcagcgccccgaggacgcccggcccgtggtcagcgacgagatgctcgcgcgctggctcgggacccgcgagccccaggctttggaacagcggcgcaagctcatgctggccgtggtcctggtcaccctcgagctcgaatgcatgcgccgcttcttcagcgaccccgagaccctgcgcaaggtcgaggagaccctgcactacactttcagacacggtttcgtcaggcaggcctgcaagatttccaacgtggagctgaccaacctggtctcctgcctggggatcctgcatgagaaccgcctgggacagaccgtgctccactctaccctgaagggcgaggcgcggagggactatgtccgcgactgcgtctttctctttctctgccacacatggcaagcagccatgggcgtgtggcagcagtgtctcgaggacgagaatctgaaggagctggacaagcttcttgctagaaaccttaaaaagctttggacgggcttcgacgagcgcaccgtcgcctcggacctggccgagatcgtcttccccgagcgcctgaggcagacgctgaaaggcgggctgcccgacttcatgagccagagcatgttgcaaaactaccgcactttcattctcgagcgatcggggatgctgcccgccacctgcaacgctttcccctccgactttgtcccgctgagctaccgcgagtgtcccccgccgctgtggagccactgctacctcttgcagctggccaactacatcgcctaccactcggacgtgatcgaggacgtgagcggcgaggggcttctcgagtgccactgccgctgcaacctgtgctccccgcaccgctccctggtctgcaacccccagctccttagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgcagctccggtcaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagaggagtcgccggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaagactactccacccgcatgaactggctcagtgccggcccctcgatgatatcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcctatggtgactcggctgagctcgctcggttgaggcatctggaccactgccgccgcctgcgctgcttcgcccgggagagctgtggcctcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgctgtactctttgtggtgagtttaataaaagctgaactaagaacctactttggaatcccttgtcgtcatcctcggaacaagaccgtcttctttaccaaccagaccaaggttcgtctgaactgcacaaccaacaggaagtaccttctctggacttttcaagacacctcactcgctgttgtcaatacccgtgacaacgacggtgttttaatccccaacaacctcaccagtggacttactttctctaccaacaaaacaaagctcatccttcaccacccttttgtagagggaacctaccagtgccgacacggaccttgtgttcacaacttccatttggtgaaccttaccagcagcagcacagttgctcctgaaagtaacctttcttctgatactaacaaacctcgtgtcggaggtgagctttgggttccatctctaacagagggtgggagttctattgaagtggttgggtatttgattttaggggtggtccttggtgggtgcatagcagtgctgtatcaacttccttgctgggtcgaaatcagggtatttatctgctgggtcagacattgtggggaggaaccatgaaggggctcttgctgattatcctttccctggtggggggtgtactgtcatgccacgaacagccacgatgtaacatcaccacaggcaatgagagaagcgaatgctctgtagttatcaaatgtgagcacaaatgttctctcaacattacattcaagaataagaccatgggaaatgtatgggtgggcttctggcaaccaggagatgagcagaactacacggtcactgtccatggtagcgatggcaaacacactttcggtttcaaattcatttttgaagtcatgtgtgatatcacactgcatgtggctagacttcatggcttgtggccccctaccaaggagaacatggtgggtttttctttggcttttgtgatcatggcctgcttgatgtcaggtctgctggtaggggctttagtgtggttcctgaagcgcaagcctaggtatggaaatgaggagaaggaaaaattgctataaatctttttctcttcgcagaaccatgaatactttgaccagtgtcgtgctgctctctcttcttgtagcttttagtcagggacaagctgtgcatgtgaaacttgaaatttgttatggttgtaatggtacactaataggaccacataaaactccagttgagtggtatgacggcagaggacacaaactttgtgcaggatctgatacttttcacaaggaactaaatcacacatgtgatttacaaaatatgacacttacatttgttaacttaactcataagggtacttactatggttttggcagtgataacaaaaactctaaagtataccaggttactattaagccacctgttctgacaactcgcaggcctttattaaaacctgaagatattgtaatcactaagggaagcaacaaaactcttgtgggtcctccagatacaccagttgactggtatgatggttcaggacataaattgtgtaaaggaaaagaagttcattaccctgaactcaatcacacctgtgatgagcagaaccttacactcatatttgtaaatgccacttttaagggaacctattatggctttagaaaagatggcacagacaaaaaggaatatagagtcaaaattgatgatttatatgcaaaacaactaaaacaggaaaaagatgaaaaaccaaggtctggccatgataagcagaaatcaaaaacagaagaaaaacaaaatccaaaaacagaagaaaggcatgggcatagagatgttgttaaagaagttagctttagaactggaactaatcaaactctagtgggcccaccagggtctaaggttgattggcttaaagttggaaatggtgggacatttagcgaactttgtaaaagcgataataaacactattcttgtaattctcaaaacttaacaataatcaatgttaccagatttgatgaaggtagctattatggctctaatgacggttcagctcattacagagtttcagtctacgacccagtacagaaaaaaagggttatgaaaatacaaccacacacaacaaaaactactgcaaaaaaaactacaaaaagcagcactaatgaaacagatgaaaactttgctttgcaacagggtaacaatggggaaaatcaatatgatgaaactaatattccttcaactactgtggcaatcgtggtgggagtgattgcgggcttcataactataatcattgtcattctgtgctacatctgctgccgcaagcgtcccagggcatacaatcatatggtagacccactactcagcttctcttactgagactcagtcactttcatttcagaaccatgaaggctttcacagcttgcgttctgattagcctagtcacacttagtttagccaaaattaatcaaatcagtgtcaaaagaggtgaaaatgttacactagatggaacttatccaaatactacatggacaagatatcaccttacaaaatgggataatatttgcaaatggaatatttcaacatataaatgtcataataatggaagcattacaattcatacttttaatatcacttctggattatacaagggagatagctataaaagagaagtgattacatcaatgtctagatttggaaatatgacagacacttatttcagcgaatatcaacaattaaaaatgtataatttaacaataattgaaccaccaactactaaagcacccactaccactaagcctaccacagttaagacaacacaacctaccactgtgcccactacacatcaaaccaccgcagtcagtacaactattgaaaccactactcacactacacagctagacactacagtgcagaatagtactgtgttggttaggtatctgttgagggaggaaagtactactgaacagacagaggctacctcaagtgccttcagcagcactgcaaatttaacttcgcttgcttcaataaatgagaccctcgtgccgatgaaacaggatcaacctaattactcaggtttggatatgcaaattactttcttaattgtctgtggagtctttattcttgtggttcttctttactttgtcttttgcaaagccagacaaaaatctcatagaacaatctacaggccagtgattggggaacctcagcccctccaagtggacggaggcttaaggaatcttctcttctcttttacagtatggtgatcagccatgattcctaggttcttcctatttaacatcctcttctgtctcttcaacatctgtgctgccttcgcggccgtctcgcacgcatcgcccgactgtctcgggcccttcccaacctacctcctctttgccctgctaacctgcacctgcgtctgcagcattgtctgcctggtcatcaccttcctgcagctcatcgactggtgctgcgcgcgctacaattacctacaccacagtcccgaatacagggacgagaacgtagccagaatcttaaggctcatctgaccatgcagactctgctcatactgctatccctcctataccctgcccttgctgatgattactctaagtgcaaattcgcggacatatggaatttcttagactgctatgatgctaaaatggatatgccttcctattacttggtaattgtggggatagtcatggtctgctcctgcactttctttgccatcatgatctacccctgttttgatcttggctggaactctgttgaggcattcacatacacactagaaagcagttcactagcctccacaccaccacccacaccgcctccccgcagaaatcagtttcccatgattcagtacttagaagagccccctccccggcccccttccactgttagctactttcacataaccggcggcgatgactgacaaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcatcaaccccatagtcatcacccagcagtcgggcgagaccaacggctgcatccactgctcctgcgaaagccccgagtgcatctactccctgctcaagaccctttgcggactacgcgacctcctccccatgaactgatgttgattaaaagcccaaaaaccaatcagccccttccccatccaaaattaatcatatgaataaatcattggaattaaacattcaataaagatcacttacttgaaatctgaaagtatgtctctggtgtagttgttcagcagcacctcagtaccctcctcccagctctgatactccagtccccggcgggcggcaaacttcctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcctccctttgtctcctccgatggattcaaaaacttccccccaggggtcctgtcactcaaactggctgacccaatcaccataactaatggagatgtctcgctcaaggtgggagggggacttgttgtggaaaaagagtctggaaagctaagtgttgaccctaagactcccttgcaagttgcaagtgacaacaaattggagctttcttataatgctccatttaaagttgaaaatgacaagctatcacttgatgtaggccacggattaaaagttataggcaatgaagtatcaagcttgcctggattaataaataagcttgttgttttaactgggaagggaattggcactgaagagttaaaagaacaaaacagtgataaaataataggagttggaattaatgtaagagcaagaggaggattgtcatttgacaatgatggctacttagtagcttggaatccaaagtatgatacacgtacactttggacaactccagacacatctcctaattgcaagatgcttacaaaaaaggactcaaagcttacactcacacttacaaagtgcggaagtcaaattttaggaaacgtatctttacttgctgtttcgggaaagtatcttaatatgacaaaggacgaaacaggagttaagataattttactatttgacagaaatggagttcttatgcaggaatcatcactcgataaagaatattggaactatagaaatgacaataatgttatcggaactccttatgaaaatgcagtggggtttatgccaaacttagtggcatatcctaaaccgacaagtgcagatgcaaaaaactattcaagaagcaagataataagtaatgtatacttaaagggtcttatatatcaaccagtaattataattgccagttttaatcaggaaaccactaatggttgtgtctattctatttcatttgatttcacctgttcaaaggattacactggccaacaatttgatgttacctcattcactttctcctatatcgcccaagaatgaaagaccaataaacgtgtttttcatttgaaaattttcatgtatctttattgatttttacaccagcacgggtagtcagtctcccaccaccagcccatttcacagtgtaaacaattctctcagcacgggtggccttaaataggggaatgttctgattagtgcgggaactgaacttggggtctataatccacacagtttcctggcgagccaaacgggggtcggtgattgagatgaagccgtcctctgaaaagtcatccaagcgggcctcgcagtccaaggtcacagtctggtggaatgagaagaacgcacagattcatactcggaaaacaggatgggtctgtgcctctccatcagcgccctcaacagtctttgccgccggggctcggtgcggctgctgcagatgggatcgggatcgcaagtctctctgactatgatccccacagccttcagcatcagtctcctggtgcgtcgggcacagcaccgcatcctgatctcgctcatgttctcacagtaagtgcagcacataatcaccatgttattcagcagcccataattcagggtgctccagccaaagctcatgttggggatgatggaacccacgtgaccatcataccagatgcggcagtatatcaggtgcctgcccctcatgaacacactgcccatatacatgatctctttgggcatgtttctgttcacaatctgccggtaccaggggaatcgctggttgaacatgcacccgtaaatgactctcctgaaccacacggccagcagggtgcctcccgcccgacactgcagggagcccggggatgaacagtggcaatgcaggatccagcgctcgtacccgctcaccatctgagctcttaccaagtccagggtagcggggcacaggcacactgacatacatctttttaaaatttttatttcctctggggacaggatcatatcccaggggactggaaactcttggagcagggtaaagccagcagcacatggcaatccacggacagaacttacattatgataatctgcatgatcacaatcgggcaacagagggtgttgttcagtcagagaggccctggtctcctcatcagatcgtggtaaacgggccctgcgatatggatgatggcggagcaagctcgactgatcctcggtttgcattgtagtggattctcttgcgtaccttgtcgtacttctgccagcagaaatgggcccttgaacagcagatacctctccttctcctgtctttccgctgctgacgctcagtcatccaactgaagtacagccattcccgcaggttctcgagcagctcctcagcatctgatgaaacaaaagttctgtccatgcggattccccttaacacatcagccaggacattgtaggccatcccaatccagttaatgcagcctggtctatcattcagaggaggtgggggaagaactggaagaaccatttttattccaagcggtctcgaaggacgataaagtgcaagtcacgcaggtgacagcgttccccgccgctgtgctggtggaaacagacagccaggtcaaaacctactctattttcaaggtgctcgactgtggcttcgagcagtggctctacgcgtacatccagcataagaatcacattaaaggctggccctccatcgatttcatcaatcatcaggttacactcattcaccattcccaggtaattctcatttttccagccttgaattatttctacaaattgttggtgtaagtccactccgcacatgtggaaaagttcccacagcgccccctccactttcataatcaggcagaccttcataatagcaacaaatctggctgctccaccacctgcagcgtgttcaaaacaacaagattcaatgagtttctgccctctgccctgagctcgcgtctcagcgtcagctgtaaaaagtcactcaagtcctcggccactacagatgccaattcagagccagggctaagcgtgggactggcaagcgtgatggagtactttaatgctccaaagctagcacccaaaaactgcacgctggaataagctctctttgtgtcaccggtgattccttccaaaaggtgagtgataaagcgaggtaggtgctctctaatcatagcagtaatggaaaaatcctctaaataagtcactagggccccagggaccacaatgtggtagctgacagcgcgtcgctcaagcatggttagtagagatgagagtctgaaaaacagaaagcatgcactaaaccagagtggcaagtcttactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattcggggcaaaagaaattatatctattgctagtcccttcctggacgggagcgatccctccagggctatctatgaaagcatacagagattcagccatagctcagcccgcttaccagtagacagagagcacagcagtacaagcgccaacagcagcgactgactacccactaacccagctccctatttaaaggcaccttacactgacgtaatgaccaaaggtctaaaaaccccgccaaaaaaaacacacacgccctgggtgtttttcgcgaaaacacttccgcgttctcacttcctcgtaacgatttcgtgactcaacttccgggttcccacgttacgtcacttttgcccttacatgtaactcagccgtaaggcgccatcttgcccacgtccaaaatggcttccatgtccggccacgcctccgcggcgaccgttagccgtgcgtcgtgacgtcatttgcatcaacgtttctcggccaatcagcagtagccccgccctaaatttaaaacctcatttgcatattaacttttgtttactttgtggggtatattattgatgatg

SEQ ID NO: 28 - DNA, 35121 bp, Adenovirus D33
  MISC_FEATURE (1)..(35121): Complete Genome
catcatcaataatataccccacaaagtaaacaaaagttaatatgcaaatgaggttttaaatttagggcggggctactgctgattggccgagaaacgttgatgcaaatgacgtcacgacgcacggctaacggtcgccgcggaggcgtggcctagcccggaagcaagtcgcgtggctgatgacgtataaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtgtgagaaaaatgagacacctgcgcctcctgcctgaaactgtgcctatggacatggctgtgcttctactggatgactttgtgaatacagtattggaggatgaactgcatccaactccgtttgagctgggacccacacttcaggacctatatgatctggaggtagatgcccatgatgacgacccgaacgaagaggctgtgaatttaatatttccagaatctatgattcttcaggctgacatagccaacgaatctatacctactccacttcatacaccgactctgtcacccatacctgaattggaagaggaggacgaactagacctccggtgttatgaggaaggttttcctcccagcgattcagaggacgaacagggtgagcagagcatggctataatctcagactatgcttgtgtggttgtggaagagcattttgtgttggacaatcctgaggtgcccgggcaaggctgtagatcctgccaatatcaccgggatcagaccggagacccaaatgcttcatgcgctctgtgttacatgaaaaagactttcagctttatttacagtaagtggagtgaatgtgagagaggctgagtgcttaacacataactgtaatgcttgaacagctgtgctaagtgtggtttatttttgttactaggtccggtgtcagaggatgagtcatcgccctcagaagacgaccacccgtctccccccgatctcacagatgacacgcccctgcaagtgatcagacccaccccagtcagactcagtggggagaggcgaatggctgttgacaaaatcgaggacttgttgcaggacatgggtggggatgaacctttggacctgagcttgaaacgccccaggaactaggcgcagctgtgctgagtcatgtgtaaataaagttgtacaataaaagtatatgtgacgcatgcaaggtgtggtttatgactcatgggcggggcttagtcctatataagtgctaacacctgggcacttaggcacagaccttcaggagctcctgatggaggtgtggactatccttgcagactttagcaagacacgccggcttgtagaggatagttcagacgggtgctccgggttctggagacactggtttggaactcctctatctcgcctggtgtacacagttaagaaggattataacgaggaatttgaaaatctttttgccgactgctctggcctgcttgattctctgaattttggccaccagtcccttttccaggaaagggtcctccacagccttgatttttccagcccagggcgcactacagccggggttgcttttgtggtttttctggttgacaaatggagccagaacacccaactgagcaggggctacattctggacttcgcggccatgcacctgtggagggcctgggtcaggcagcggggacagagaatcttgaactactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcagggtgctgacatccatggccaggggagtgaagagggagaggagcgatgggggcaataccgggatgatgacagagctgacggccagcctgatgaatcgcaagcgcccagagcgcattacctggcatgagctacagatggagtgcagggatgaggtgggcctgatgcaggataaatatggcctggagcagataaaaacccactggttgaacccagatgaggattgggaggaggccattaagaaatatgccaagatagccctacgcccagattgcaagtacagggtgaccaagacggtgcatatcagacatgcctgctacatctcagggaacggggcagaggtggtcatcgataccctggacaaggccgccttcaggtgttgcatgatgggaatgagagccggagtgatgaatatgaattccatgatctttatgaacatgaagttcaatggagagaagtttaatggggtgctgttcatggccaacagccacatgaccctgcatggctgcgactttttcggctttaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacatgcgactcgggggtctgccatattctgaagaacatccatgtgacctcccacccccggaagaagtggccagtgtttgagaataacctgcttatcaagtgccacgtgcacctgggtgccagaaggggcaccttccagccgtaccagtgtaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggacgggcgcccagtgcttccagcaaattcctcgaccatgacctacgcgaccgtggggaactcgtcgcttgacagcaccgccgcagccgcggcagccgcagccgccatgacagcgacgagactggcttcgagctacatgcccagcagcagcagtagcccctctgtgcccagttccatcatcgccgaggagaaactgctggccctgctggccgagctggaagccctgagccgccagctggccgccctgacccagcaggtgtccgatctccgcgagcaacagcagcaaaataaatgattcaataaacacagattctgattcaaaagcaaagcatctttattatttattttttcgcgcgcggtaggccctggtccacctttcccgatcattgagagtgcggtggattttttccaggacccggtagaggtgggattggatgttgaggtacatgggcatgagcccgtcccgggggtgtaggtagcaccactgcatggcctcgtactctggggtcgtgttgtagatgatccagtcatagcaggggcgctgggcgtggtgctggatgatgtccttgaggaggagactgatggccacggggagccccttggtgtaggtgttggcaaagcggttgagctgggagggatgcatgcggggggagatgatgtgcagtttggcctggatcttgaggttggcaatgttgccgcccagatcccgcctggggttcatgttgtgcaggaccaccaggacggtgtagcccgtgcacttggggaacttatcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaataaatttggggcggagggtgccagattgggggacgatggttccctcgggccccggggcaaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggttgggccgtagatgaccccgatgacgggttgcaggtggtagttcaaggagatgcagctgccgtcgtcccggaggaggggggccacctcgttgagcatgtccctgacttggaggttttcccggacgagctcgccaaggaggcggtctccgccgagcgagagtagctcttgcagggaagcaaagtttttcaggggcttgagcccgtcggccatgggcatcttggcgagggtctgcgagagtagctccaggcggtcccagagctcggtgacgtgctctacggcatctcgatccagcagacttcctcgtttcgggggttgggacgactgcgactgtagggcacgagacgatgggcgtccagcgctgccagcgtcatgtccttccatggtctcagggtccgcgtgagcgtggtctccgtcacggtgaaggggtgggccccgggctgggcgcttgcaagggttcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggtgcgagaaagacggactcgggggcgaaggcgtccgctccgcagtgggcgcagacggtctcgcactcgacgagccaggtgagctcggggtgttcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccactttttccacggtatgcaggcacatgtccccctcctccgcatccaagaaggttattggcttgtaggtgtaggccacgtgacctggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcgatgctttttaggagactttcatccatctggtcagaaaagactatttttttattgtcaagcttggtggcgaaggagccatagagggcattggagagaagcttggcgatggatctcatggtctgatttttgtcacggtcggcgcgctccttggccgcgatgttgagctggacatactcgcgcgcgacgcacttccattcggggaagacggcggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaaagggggcaacacatcaagcagatgctcgtcaggggggtccgcatcgatggtgaagatgccgggacatagttccttgtcaaaatagtctatttttgaggatgcatcatccaaggccatctgccactcgcgggcggccatcgctcgctcgtaggggttgaggggcggaccccagggcatggggtgcgtgagcgcggaggcatacatgccgcagatgtcatacacatagatgggctctgagaggatgccgatgtaggtgggataacagcgccccccgcggatgctggcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtggggcagtcggaccgagtcgcggatgaagtgcgcgtaggagtcttgcagcttggcgacgagctcggcggtgacgaggacgtccatggcgcagtagtccagcgtttctcggatgatgtcataacccgcctctcctttcttctcccacagctcgcggttgagggcatactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgagtcagggcgaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgctcgcggcatgaaattgcggctgatgcggaaagggcccgggacggaggctcggttgttgatgacctgggcggcgaggacgatctcgtcgaagccgttgatgttgtgcccgacgatgtaaagttccatgaatcgcgggcggcctttgatgtgcggcagctttttgagctcctcgtaggtgaggtcctcggggcattgcaggccgtgctgctcgagggcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcggggtcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacactgcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcacgcagttgggagctgtccatggtgtcgcggagatccaggtccgggggcagggttctgaggttgacctcgtagaggcgggtgagggcgtgcttgagatgcagatggtacttgatttccactggggagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctcgacggtggcggcgaggtcatttgagatgcgacccatgagctgcgagaaggcgcccagcccgctctcgttccagacgcggctgtagactacgtccccgtcggcgtcgcgcgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcttcgtagaaatccacggcgaagttgaaaaactgggcgttgcgggccgagaccgtgagctcgtcttccaggagccggatgagctcggcgatggtggcgcgcacctcgcgctcgaaatccccgggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagtagccccgtggacgctgttagaattgcggttgctgatgatgtaattgaagtaggcgtttttaaggcggcggatggtggcgaggaggaccaggtccttgggtcccgcttgctggatgcggagccgctcggccatgccccaggcctggccctgacaccggctcaggttcttgtagtagtcatgcatgagcctctcaatgtcatcactggcggaggcggagtcttccatgcgggtgaccccgacgcccctgagcggttgcacaagcgccaggtcggcgacgacgcgctcggcgaggatggcctgttgcacgcgggtgagggtgtcctggaagtcgtccatgtcgacgaagcggtggtaggccccggtgttgatggtgtaggtgcagttggccatgagcgaccagttgacggtctgcaggccgggttgcacgatctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgccaggggccaggtcctcgagcatgaggcggtggtagccgtagaggtagcgggacatccaggtgatgccggcggcggtggtggaggcgcgcgggaactcgcggacgcggttccagatgttgcgcagcggcaggaaataatccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgaggggagtcgctagacttgaaagcggccgaaaaccccgccgggtagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgcgtgcagctacagaaggacgtgcgcccggcgtacgtgcctccgcagaacctgttcagggaccgcagcggggaggagcccgaggagatgcgcgactgccgttttcgggcgggcagggagctgcgcgagggcctggaccgccagcgcgtgctgcgcgacgaggatttcgagccgaacgagcagacggggatcagccccgcgcgcgcgcacgtggctgcggccaacctggtgacggcctacgagcagacggtgaagcaggagcgcaacttccaaaagagtttcaacaaccatgtgcgcacgctgatcgcgcgcgaggaggtggccctgggcctgatgcacctgtgggacctggcggaggccatcgtgcagaatccggacagcaagcctctgacggcgcagctgttcctggtggtgcagcacagcagggacaacgaggcgttcagggaggcgctgctgaacatcgccgagcccgagggccgctggctgctggagctgattaacatcttgcaaagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcgcgagccggcggcgcgagctgagcgaccgcgagctgatgctgagcctgcgccgggcgctggtagggggcgccgccggcggcgaggagtcctacttcgacatgggggcggacctgcattggcagccgagccggcgcgccttggaggccgcctacggtccagaggacgacttggatgaggaagaggaggaggatgcacccgctgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccacaggccaacagactttcggccattctggaggcggtggtcccctctcggaccaaccccacgcatgagaaggtgctggcgatcgtgaacgcgctggcggagaacaaggccatccgtcccgacgaggccgggctggtgtacaacgccctgctggagcgcgtgggccgctacaacagcacaaacgtgcagtccaacctggatcggctggtgacggacgtgcgcgaggccgtggcgcagcgcgagcgattcaagaacgagggccttggctcgctggtggcgctgaacgccttcctggcaacgcagccggcgaacgtgccgcgcgggcaggacgattataccaactttatcagcgcgctgcggctgatggtgaccgaggttccccagagcgaggtgtaccagtcgggcccggactactttttccagactagcagacagggcctgcagacggtgaacctgagccaggctttcaagaacctgcgcgggctgtggggcgtgcaggcgcccgtgggcgaccggtcgacggtgagcagcttgctgacgcccaactcgcggctgctgctgctgctgattgcgcccttcaccgacagcggcagcgtgaaccgcaactcgtacctgggccacctgctgacgctgtaccgcgaggccataggccaggcgcaggtggacgagcagaccttccaggagattactagcgtgagccgcgccctgggtcagaacgacaccgacagtctgagggccaccctgaacttcttgctgaccaatagacagcagaagatcccggcgcagtacgcgctgtcggccgaggaggagcgcatcctgagatatgtgcagcagagcgtagggctgttcctgatgcaggagggcgccacccccagcgctgcgctggacatgaccgcgcgcaacatggaacctagcatgtatgccgccaaccggccgttcatcaataagctgatggactacctgcaccgcgcggcggccatgaactcggactactttaccaatgccattttgaacccgcactggctcccgccgccggggttctacacgggcgagtacgacatgcccgaccccaacgatgggttcctgtgggacgacgtggacagcgcggtgttctcaccgaccttgcaaaagcgccaggaggcggtgcggacgcccgcgagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggagcctgcgcccgcgccgcggcgccagcgccacgaccggcagcggggcctggtgtgggacgacgaggactcggccgacgatagcagcgtgttggacttgggcgggagcggtggggccaacccgttcgcgcatctgcagcccaaactggggaggcggatgttttgaaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtatttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctagaaagcatcccaaagatgtagatgcaagtgatttaagcaaggatatcttagagtatgattggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggcggtaacatccccgctctcctggataccaaaaaatatctggatagcaagaaagaaattgaagatgcaaaacagaaagcggcccaggcaggtggcgagatcagaggagacagtgctgatactagagctgcagaacaggcgactgaaaaagagctggttattgaacccatcgagcaagatgaaagcaagagaagctataatgtgatcaagggtacccatgacaccctgtaccgaagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgttctacccagcaagtcagcaactaccccgtggtcggcgccgagctcatgcccttccgcgccaagagcttttacaacgacctcgccgtctactcccagctcatccgcagctatacctccctcacctacgtcttcaaccgcttccccgacaaccagatcctatgccgcccgcccgcgcccaccatcaccaccgtcagtgaaaacgtgcctgctctcacagatcacgggacgcttccgctgcgcagcagtatccgcggagtccagcgagtgaccgtcactgacgcccgtcgccgcacctgtccctacgtctacaaggccctgggcatagtcgcgccgcgcgtgctctccagtcgcaccttctaaaaaatgtctattctcatctcacccagcaataacaccggctggggtcttactaggcccagcaccatgtacggaggagccaagaagcgctcccagcagcaccccgtccgcgtccgcggccacttccgcgctccctggggagcttacaagcgggggcggacttccaccgccgccgtgcgcaccactgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccacaggagcacgcccgccatgcgcgccgcccgagctctgctgcgccgcgccagacgcacgggtcgccgggccatgatgcgagccgcgcgccgcgccgccactgcaccccccgcaggcaggactcgcagacgagcggccgccgccgccgccgcggccatttctaacatgaccagacccaggcgcggaaacgtgtactgggtacgcgactccgtcacgggcgtgcgcgtgcccgtgcgcacccgtcctcctcgtccctgatctaatgcttgtgtcctcccccccgcaagcgacgatgtcaaagcgcaaaatcaaggaggagatgctccaggtcgtcgccccggagatttatggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctcatctcgctgccgctggacgagagcaaccccacgccgagcctgaagcccgtgaccctgcagcaggtgctgccccaggcggtgctgctgccgagccgcggggtcaagcgcgagggcgagaacatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgtctccacttctaccgccgccacggctaccgagcctcccaggaggcgaagatggggcgccgccagccggctgatgcccaactacgtgttgcatccttccattatcccgacgcctggctaccgcggcacccggtactacgccagccgcaggcgcccagccaccaagcgccgccgccgcaccacccgccgccgtctggccccagcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatccctggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgtctggacccgcggccgcccacggtggtggagatggaagatgcaactcttccgccgcccaagggcgagaagcgcccgcggcccgacgcggaggagacgatcctgcaggtggacgagccgccctcgtacgaggaggccgtgaaggccggcatgcccaccacgcgcatcatcgcgccgctggccacgggtgtaatgaaacccgccacccttgacctgcctccaccacccacgcccgctccaccgaaggcagctccggttgtgcagccccctccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctcgaccgcggtcccagcttcaaaccctactcgggcacggcttacaacagcctggcccccaagggcgcccccaattccagtcagtgggaacagaaaaaggccactgggggagctgatgcaaaggaaacacatacattcggtgtagccgctatgggaggattgaacattacagacaaaggtttgcaaattggaatagatgaagataatgtagatggagatgatgagatatatgctgacaaaacttttcaaccagaacctcaagtgggagaggaaaactggaaagaaagttttaatttctatggaggcagagctattaagaaagacaccaaaatgaagccatgctatggttcctatgccagacccaccaatgttaagggaggtcaggctaaacttaaaactggagaagatatagaccctaacaaggactttgacatagacatggctttctttgatctaaagcaagctgacacaggaggtaataacaatcaagcagacgtggttatgtataccgaaaatattcatctggaaactccagacactcatgtggtgtacaagccaggcaaggaagatgcaagttctgaaattaacttgactcagcagtccatggccaacagacccaactacattggcttcagagacaactttgtagggctcatgtactacaacagcactggcaacatgggtgtgctggccggtcaggcatctcagttgaatgcagtggtcgacttgcaagacagaaacaccgagctgtcttaccagctcttgctagattctctgggcgacagaaccagatactttagcatgtggaactctgctgtggacagctatgatcccgatgtcaggatcattgagaatcacggtgtggaagatgaacttccaaactattgcttcccattggacggatctggcagcagtactgcttttcagggagttaaagtaaaaaccccggctggtactggtcaaaacactgtatgggaagttaacaatgatgctgcaacgcataaccaaattgcaagaggcgacctgtacgccatggagatcaacctccaggccaacctgtggaagagttttctgtactcgaacgtggccctgtacctgcccgactcctacaagtacactccggccaatgtcacgctgcccaccaacaccaacacctacgagtacatgaacggccgcgtggtggccccctcgctggtggacgcctacatcaacatcggcgcccgctggtcgctggaccccatggacaacgtcaaccccttcaaccaccaccgcaacgcgggcctgcgctaccgctccatgcttctgggcaacggccgctacgtgcccttccacatccaagtgccccaaaagttctttgccatcaagaacctgctcctgctcccgggctcctacacctacgagtggaacttccgcaaggatgtcaacatgatcctgcagagttccctcggcaacgacctgcgcgtcgacggcgcctccgtccgcttcgacagcgtcaacctctacgccaccttcttccccatggcacacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaggaaactccctccctcggctcgggtttcgacccctactttgtatactcgggctccatcccctaccttgacgggaccttctacctcaaccacaccttcaagaaggtctccatcatgttcgactcctcggtcagctggccaggcaacgaccggctgctcacgccgaacgagttcgagatcaagcgcagcgtcgacggggagggctacaacgtggcccaatgcaacatgaccaaggactggttcctcgtccagatgctctcccactacaacatcggttaccagggcttccatgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctacctcgcgcccaccatgcgccaggggcagccctaccccgccaacttcccctacccgctcatcggctccaccgccgtgccctccgtcacccagaaaaagttcctctgcgacagggtcatgtggcgcatccccttctccagcaacttcatgtccatgggcgccctcaccgacctgggtcagaacatgctctatgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacataagcatgagcggctccagcgaaagagagctcgcggccatcgtgcgcgacctgggctgcgggccctactttttgggcacccacgacaagcgcttccctggcttcctcgccggcgacaagctggcctgcgccatcgtcaacacggccggccgcgagaccggaggcgtgcattggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctgaggcgcaaccaggaggagctctaccgcttcctagcgcgccactccccttactttcgatcccaccgcgccgccatcgaacacgccaccgcttttgataaaatgaaacaactgcgtgtatctcaataaacagcactttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagtatgtcaggcgcggagatcttgaaatcgcagttgggaccggtgctctgcgcgcgcgagttgcggtacacggggttgcagcactggaacaccatcagactggggtgcttcacgctggccagcacgctcttgtcgctgatctgatccttgtccaggtcctcggcgttgctcaggccgaacggtgtcatcttgcacagctggcggcccaggaagggcacgctctgaggcttgtggttacactcgcagtgcactggcatcagcatcatccccgagccgcgctgcatattcgggtagagggccttgacaaaggccaagatctgcttgaaagcttgctgggccttggccccctcgctgaagaacaggccgcagctcttcccgctgaactggttatttccacacccggcatcatgcacgcagcagcgcgcgtcatggctggtcagttgcaccacgctccgtccccagcggttctgggtcaccttggccttgctgggctgctccttcaacgcacgctggccgttctcgctggtcacatccatctccaccacgtgatccttgtggatcatcaccgttccatgcaggcacttgagctggccttccacctcggtgcagccgtgatcccacagggcgcagccggtgcattcccaattcttgtgcgcgatcccgctgtggctgaatatgtaaccttgcaacatgcggcccatcacggtgctaaatgatttactggtgctgaaggtcagttgcaggccgcgggcctcctcgttcatccaggtctggcacatcttttggaagatctcggtctgctcgggcatgagcttgtaagcatcgcgcaggccgctgtcgacgcgatagcgttccatcagcacgttcatggtatccatgcccttctcccaggacgagaccagaggcagactcagggggttgcgcacgttcaggacaccgggggtcgcgggctctacgatgcgttttccgtcctttccttccttcaacaggaccggcggctggctgaatcccactcccacgatcacggcttcttcctggggcatctcttcgtcggggtccgtcttggtcacatgcttggtctttctggcttgcttcttttttggagggctgtccacggggaccacgtcctcctcggaagacccggagcccacccgctgatactttcggcgcttggtgggcagaggaggtggcggcgaggggctcctctcctgctccggcggatagcgcgctgaaccgtggccccggggcggagtggcctctcggtccatgaaccggcgcacgtcctgactgccgccggccattgtttcctaggggaagatggaggagcagccgcgtaagcaggagcaggaggaggagaacttaaccacccacgaacaagcaaaaatcgagcaggacctgggcttcgaagagccggctcgtctagaacccccacaggatgaacaggagcacgagcaagacgcaggccaggaggagaccgacgctgggctcgagcatggctacctagaggaggacatgctgctgaaacacttgcagcgccaatccctcatcctcagggacgccctggccgaccggagcgagacccccctcagcgtcgaggagctaagtagggcctacgagctcaaccttttctcgccgcgcgtgccccccaaacgccagcccaacggcacctgcgagcccaacccgcgcctcaacttttaccccgttttcgcggtccccgaggccctggccacctatcacatctttttcaagaaccaaaagatccccgtctcctgtcgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcaaactagcgccctggtagagttggaaggcgacaacgccaggctggccgtactcaagcgcagcgtcgagctcacccacttcgcctaccccgccgttaacctcccgcccaaggtcatgcgtcgcatcatggatcagctcatcatgccccacatcgaggccctcgatgagacgcaagagcagcggcccgaggacgcccagcccgtggtcagcgacgagcagctcgcgcgctggctcgaaaaccgcgacccccaggtcctggagcagcggcgcaagctcatgctggccgtggtccttgttaccctcgagctggaatgcatgcgccgcttcttcagcgaccccgacaccctgcgcaaggtcgaggagacactgcactacactttcaggcacggctttgtcaggcaggcctgcaagatctccaacgttgagctgaccaacctggtctcctgcctggggatcctgcacgagaaccgcctggggcagaccgtgcttcactctaccctcaagggagaggcgcgtcgggactacatccgcgactgcgtctttctctttctttgccacacctggcagtcggccatgggagtgtggcagcagtgtctagaggacgagaacctgaaggagctggacaagcttcttgctagaaacctcaaaaagctgtggacgggcttcgacgagcgcaccgtcgcctcggacctggccgaaatagtcttccccgagcgcctgaggcagacgctgaaaggcgggctgcccgacttcatgagccaaagcatgttgcaaaactaccgcactttcattctcgagcgatcggggatcctgcccgccacctgcaacgccttcccctccgactttgtcccgctgagctaccgcgagtgtcccccgccgctgtggagccactgctacctcttgcagctggccaactacatcgcccaccactcggatgtgatcgaggacgtgagcggcgaggggctgctagagtgccactgccgctgcaacctgtgctccccgcaccgctccctggtctgcaacccacagctcctcagcgagacccaggtcatcggtaccttcgagctgcaaggtccggagaagtccaccgctccgctgaaactcacgccggggttgtggacttccgcgtacctgcgcaaatttgtacccgctgactaccacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgctccggtcaagcctcctcgtagatgggatcgagtgaagggtgacggtaagcacgagcggcagggctaccgatcatggaggacccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaaatcagaagtaagaggagtcgccggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaattggctaagtgccggcccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgttccgcccacaaccgggtataaaaaccctggtgatccgaggcagaggcacacagctcaacgacgagttggtgagctcttcgatcggtctgcgaccggacggagtgttccaactagccggagctgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaatcggtggacggctacgactgaatgtcccatggtgactcggctgagctcgctcggttgaggcatctggaccactgccgccgcctgcgctgcttcgcccgggagagctgcggcctcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgctgtactctttgtggtgagtttaataaaagctgaactaagaacctactttggaatcccttgtcgtcatcctcggaacaagaccgtcttctttaccaaccagaccaaggttcgtctgaactgtacaaccaacaggaagtaccttctctggactttccaagacacctcactcgctgttgtcaatacccgtgacaacgacggtgttttaatccccaacaacctcaccagtggacttactttctctaccaacaaaacaaagctcatccttcaccacccttttgtagagggaacctaccagtgccgacacggaccttgtgttcacaacttccatttggtgaaccttaccagcagcagcacagttgctcctgaaactaacctttcttctgatactaacaaacctcgtgtcggaggtgagctttgggttccatctctaacagagggtgggagttctattgaagtggttgggtatttgattttaggggtggtccttggtgggtgcatagcagtgctgtatcaacttccttgctgggtcgaaatcagggtatttatctgctgggtcagacattgtggggaggaaccatgaaggggctcttgctgattatcctttccctggtggggggtgtactgtcatgccacgaacagccacgatgtaacatcaccacaggcaatgagagaagcgaatgctctgtagttatcaaatgtgagcacaaatgttctctcaacattacattcaagaataagaccatgggacatgtatgggtgggcttctggcaaccaggagatgagcagaactacacggtcactgtccatggtagcgatggcaatcacactttcggtttcaaattcatttttgaagtcatgtgtgatatcacactgcatgtggctagacttcatggcttgtggccccctaccaaggagaacatggtgggtttttctttggcttttgtgatcatggcctgcttgatgtcaggtctgctggtaggggctctagtgtggttcctaaagcgcaagcccaggtacggaaatgaagagaaggaaaaattgctataaattctttttcttttcacagcaccatgaatactttgaccagtgtcgtgctgctctctcttcttgtggttcttagtcagggacaaatagaacatgaaaaacagagtgttcagtggggaaagaacataacgcttgtgggtcctaatgataaacctgttgaatggcacggacctagagatcaactttgtaagggaaaacaaatcttacacccagaattcaatcacacatgtaatgaacaaaacctcacactactttttgtgaataacactttccagggaatatattatggcattagaaatgatggtagaggtatgaaacaaattcaactaacagttgttgcacctcctgcctccacacgaaaacctttgtcaaagccaaaacaagtgaatgtccaatatggacataatgtaacattagaaggtcctccaggaatacctattgactggctcggaccaactaatcagctttgtaaaggaaaagaaattttacacccagaaataaaccatacctgtaatgttcaaaatttaacacttttatttgtaaactatactcaccgtggagcatattttggctttaacaaagacggaactgacagacatcactatgaggttactattctagatgggttcacaaatgcagggcagacaaaagaagagtcagtcagtgacaaatcaaaaggaaaaacttcttcaaaagagaaaaaaactcaaaaaaataactctcagagaaatgatgatgttaaagagttagattttcccagtggatctaatcaaactttagttggcccccctggatcaaaagttgattggtacacaacaaaaaatggtgactttacaaaattgtgtgatggattaaatggaccaaaaaatctgtgtaattatcagaacttaacattgcgaaatgtaagcagacaggacgaaggaacttattttgggtctaacgaacagtcaaagcattacagagttactgtctatacaaaacctagaaatcaaactaagagaatccagccatatactactaaaggaactacaaaatcaaccttaggtaatcacagctttgaattgcaactggcagatgatcaatctaatcaacaggatcaacaaattccatcaactactgtggcaatcgtggtgggagtgattgcgggctttataactataatcattgtcattctgtgctacatctgctgccgcaagcgtcccaggtcatacaatcatatggtagacccactactcagcttctcttactgaaactcagtcactctcatttcagaaccatgaaggctttcacagcttgcgttctgattagcatagtcacacttagtgcagctgctggtaaatgctatcatacagttaatgtcactaggggagggaatattacacttacaggggcaggaatcaacactacatggacagcttatcataacgatggaaaggggcaaaatggttggttgcccatctgtacatggggcgatcccatctatgtgtgccatggaaatagcagtactatttccaatcttacagttgtagctcacaaaaatctaactgacagaactattaaggcatatagctatgagaacaaagatgattatgaaacagtaaattcatgcttttatgttgtaaaagttgttgagcttccaaccactaaagcgcccacacagtctactacacatccaaccaccacagccagtacaactactgagaccactactcaaactacacagctagacactacagtgcagaatagtactgtgttggttaggtatttgttaagggaggaaagtactactgaacagacagaggctacctcaagtgccttcagcagcactgcaaatttaacttcgcttgcttcggtaaatgagacgatcgtgccgatgatgtatggccaacattacccaggtttggatatacaaattactttcctgattgtctgtggggtctttatcctcgctgtccttctctactttgtctgctgcaaggccagagaaaaatctaggcggcccatctacaggccagtaatcggggaacctcagccactccaagtggatggaggcttaaggaatcttctcttctcttttacagtatggtgatcagccatgattcctaggttcttcctatttaacatcctcttctgtctcttcaacatctgcgctgccttcgcagccgtctcgcacgcctcacccgactgtctcgggcccttccccacctacctcctctttgccctgctcacctgcacctgcgtctgcagcattgtctgcgtggtcatcaccttcctgcagctcatcgactggtgctgcgcgcgctacaattacctacaccacagtcccgaatacagggacgaaaacgtagccagaatcttaaggctcatatgaccatgcagactctgctcatactgctatccattctatcccctgccctagctgatgattactctaagtgcaaattcgcggacatatggaatttcttagactgctatcaggagaaaatggatatgccttcctattacttggcgattgttggggtagtcatggtctgctcctgcactttctttgccattatgatctacccatgttttaatctcggctggaactctgttgaggcattcacatacacactagaaagcagttcactagcctccacaccaccactcacaccgcctccccgcagaaatcagttccccatgattcagtacttagaagagccccctccccgacccccttccactgttagctactttcacataactggcggcgatgactgaccacctggacctcgagatggacggccaggcctccgagcagcgcatcctgcaactgcgcgtccgacagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcacctatgagatgccccagcagaagcagaaattcacctgcatggtgggcgtcaaccccatagtcatcacccagcagtcgggcgagaccaacggctgcatccactgctcctgcgaaagccccgagtgcatctactccctcctcaagaccctttgcggactccgcgacctcctccccatgaactgatattgattaaaagcccaaaaaccaatcagacccttcccccatttccccatccccaaactactcataacaataaatcattggaactaatcattcaataaagatcacttacttgaaatctgaaagtatgtctctggtgtagttgttgagcagcacctcggtaccctcctcccagctctggtactccagtccccggcgggcggcgaacttcctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcccccctttgtctcctccgatggattccaaaacttcccccctggtgtcctgtcactcaaactggctgacccaatcaccatcgccaatgggaatgtttcactcaaggtgggagggggactcactctggaacaagatagtggaaagctaattgtgaatcctaaggctcccttgcaagttgcaaatgacaaattagagctttcttacgcagatccatttgaaactagtgctaataaacttagtttaaaagtagggcatggactaaaagtgttggatgagaaaaatgctggaggattgaaagatttaattggcacacttgtagttttaactggaaaaggaataggcgttgaagagttaaaaaacgctgataatactaataggggagttggaattaatgtaagactgggtaaagatggaggtttgtcctttgataaaaaaggcgacttagtagcttggaataagcatgatgacagacgcactttatggacaactccagacccatctccaaattgtacaattgatgaggaaagagattcaaagctcactttagtgttaacaaaatgcggtagtcaaattttggccaatgtctctttacttgttgtaaaaggaaaatttagtaacataaacaataatactaatccaactgataaaaaaatcacagtgaagctactttttaatgaaaagggagtattaatggacagttcgtcacttaaaaaagaatattggaactacagaaatgataattctactgtatctcaggcctatgataatgcagttccttttatgccaaacataaaagcttatcctaaacctaccacagacacttcagctaaaccagaagataaaaaaagtgctgctaaaagatacattgtgagcaatgtctatattggaggcttgccagataaaactgttgttataactattaagttgaatgcagaaactgaatctgcttattcaatgacctttgaatttacatgggcaaaaacatttgaaaatttgcagtttgattcctcctcttttaccttctcctatattgctcaagaaaatgaggacgaagacaaataaaatgttttaaaatgaattcatgtatctttattgatttttacaccagcacgggtagtcagtctcccaccaccagcccatttcacagtgtaaacaattctctcagcacgggtggccttaaatagggaaatgttctgattagtgcgggaactggacttggggtctataatccacacagtttcctggcgagccaaacgggggtcggtgattgagatgaagccgtcctctgaaaagtcatccaagcgggcctcacagtccaaggtcacagtctggtggaacgagaagaacgcacagattcatactcggaaaacaggatgggtctgtgcctctccatcagcgccctcagcagtctctgccgccggggctcggtgcggctgctgcagatgggatcgggatcgcaagtctctctgactataatcccaacagccttcagcatcagtctcctggtgcgtcgggcacagcaccgcatcctgatctctgccatgttctcacagtaagtgcagcacataatcaccatgttattcagcagcccataattcagggcgctccagccaaagctcatgttggggatgatggaacccacgtgaccatcgtaccagatgcggcagtatatcaggtgcctgcccctcatgaacacactgcccatatacatgatctctttgggcatgtctctgttcacaatctggcggtaccatgggaagcgctggttgaacatgcacccgtaaatgactctcctgaaccacacggccagcagggtgcctcccgcccgacactgcagggagcccggggatgaacagtggcaatgcaggatccagcgctcgtacccgctcaccatctgagctctcaccaagtccagggtagcggggcacaggcacactgacatacatctttttaaaatttttatttcctctggggtcaggatcatatcccaggggactggaaactcttggagcagggtaaagccagcagcacatggtaatccacggacagaacttacattatgataatctgcatgatcacaatcgggcaacaggggatgttgttcagtcagagaggccctggtctcctcatcagatcgtggtaaacgggccctgcgatatggatgatggcgcagcgagctggattgaatctcggtttgcattgtagtggattctcttgcgtaccttgtcgtacttctgccagcagaaatgggcccttgaacagcagatacccctcctgcggccgtcctttcgctgctgccgctcagtcatccaactgaagtacatccattctcgaagattctggagaagttcctctgcatctgatgaaacaaaaaacccgtccatgcgaattcccctcatcacatcagccaggactctgtaggccatccccatccagttaatgctgccttgtctatcattcagagggggcggtggcaggattggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtagcttcgagcagtggctctacgcgtacatccagcataagaatcacattaaaggctgggcctccatcgatttcatcaatcatcaggttacactcattcaccattcccaggtaattctcatttttccagccttgaattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcgcccaaaaactgcatgctggaataagctctctttgtgtcaccggtgatgccttccaagaggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagtggcaagtctcactgaaggaaaaatcactctctccagcaacagtgtgcccactgggtggccctcgcggacatacaaaaatcggtccgtgtggttaaagagcagcacagttagctcatgtcttctcccggcaaaaatcacatcggactgggttagtatgcccctggcatggtagtcatttaaggccaaaaatctgccttggtagccagtaggaattagcacgctcactcttaggtgaaccaaaaccaccccatgcggaggaatgtgaaaagattcggggcaaaagaaattatatctattgctaaacccttcctgaacgggagcgatccctccagggctatctataaaagcatacagagattcagccatagctcagcccgcttaccagtaaacatagagcacagcagtacaagcgccaacagcagcgactaactagccactaacccagctccctatttaaaggcaccttacactgacgtaattaccaaaggtctaaaaaccccgccaaaaaaaacacacacgccctgggtgtttttcgcgaaaacacttccgcgttctcacttcctcgtatcgatttcgtgactcaacctccggattcccacgttacgtcacttctgcccttacatgtaacttatccgtagggcgccatcttgcccacgtccaaaatggcttccatgtccagccacgcctccgcggcgaccgtcagccgtgcgtcgtgacgtcatttgcatcaccgcttctcggccaatcagcattggctccgccccaaaaccgttaaaattcaaaagctcatttgcatattaacttttgtttactttgtggggtatattattgatgatg

SEQ ID NO: 29 - DNA, 35215 bp, Adenovirus D37
  MISC_FEATURE (1)..(35215): Complete Genome
atcatcaataatataccccacaaagtaaacaaaagttaatatgcaaatgagcttttgaattttaacggttttggggcggagccaacgctgattggacgagaagcggtgatgcaaataacgtcacgacgcacggctaacggccggcgcggaggcgtggcctaggccggaagcaagtcgcggggctaatgacgtataaaaaagcggactttagacccggaaacggccgattttcccgcggccacgcccggatatgaggtaattctgggcggatgcaagtgaaattaggtcattttggcgccaaaactgaatgaggaagtgaaaagtgaaaaatacctgtcccgcccagggcggaatatttaccgagggccgagagactttgaccgattacgtggggtttcgattgcggtgtttttttcgcgaatttccgcgtccgtgtgaaagtccggtgtttatgtcacagatcagctgatccacagggtatttaaaccagttgagcccgtcaagaggccactcttgagtgccagcgagtagagatttctctgagctccgctcccaaagtgtgagaaaaatgagacacctgcgcctcctgtcttcaactgtgcctattaacatggccgcattattgctggaggactatgtgagtacagtattggaggacgaactacatccatctccatttgagctgggacctacacttcaggacctttatgatttggaggtagatgcccatgatgacgacccaaacgaagaggctgtgaatttaatatttccagaatctctgattcttcaggctgacatagccagcgaagctgtacctacaccacttcatacaccgactttgtcacccatacctgaattggaagaggaggacgagttagacctccgatgttatgaggaaggttttcctcccagcgattcagaggacgaacagggtgagcagagcatggctctaatctcagaatatgcttgtgtggttgtggaagagcattttgtgttggacaatcctgaggtgcccgggcaaggctgtagatcctgccagtaccaccgggataagaccggagacacaaacgcctcctgcgctctgtgttacatgaaaaagaacttcagctttatttacagtaagtggagtgaatgtgagagaggctgagtgcttaacacataactgggtgatgcttaaacagctgtgctaagtgtggtttatttttgtttctaggtccggtgtcagaggatgagtcatcaccctcagaagaaaaccacccgtgtccccctgagctgtcaggcgaaacgcccctgcaagtgcacaaacccaccccagtcagacccagtggcgagaggcgagcagctgttgaaaaaattgaggacttgttacatgacatgggtggggatgaacctttggacctgagcttgaaacgccccaggaactaggcgcagctgtgcttagtcatgtgtaaataaagttgtacaataaaagtatatgtgacgcatgcaaggtgtggtttatgactcatgggcggggcttagtcctatataagtggcaacacctgggcactgggcacagaccttcagggagttcctgatggatgtgtggactatccttgcagactttagcaagacacgccggcttgtagaggatagttcagacgggtgctccgggttctggagacactggtttggaactcctctatctcgactggtgtacacagttaagaaggattataacgaggaatttgaaaatctttttgctgattgctctggcctgctagattctctgaatctcggccaccagtcccttttccaggaaagggtactccacagccttgatttttccagcccagggcgcactacagccggggttgcttttgtggtttttctggttgacaaatggagccagaacacccaactgagcaggggctacattctggacttcgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcttgtacccagagcttagcaaggtgctgacatccatggctaggggagtgaagagggagaggagcgatgggggcaataccgggatgatgaccgagctgacggccagcctgatgaatcgcaagcgcccagagcgcattacctggcacgagctacagatggagtgcagggatgagttgggcctgatgcaggataaatatggcctggagcagataaaaacacattggttgaacccagatgaggattgggaggaggccattaagaaatatgccaagatagccctgcgcccagattgcaagtacatagtgaccaagaccgtgaatattagacatgcctgctacatttcagggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttctttggcttcaacaatatgtgcgccgaggtctggggcgcttccaagatcaggggatgtaagttttatggctgctggatgggcgtggtcggaagacctaagagcgagatgtctgtgaagcagtgtgtgtttgagaaatgctacctgggagtctctaccgagggcaatgctagagtgagacactgctcttccctggatacgggctgcttctgcctggtgaagggtacggcctctctgaagcataatatggtgaagggctgcacagatgagcgcatgtacaacatgctaacatgcgactcgggggtctgtcatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggaaaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaatgtgagtataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatctacggtggatgggcgtccagtgcttccagcaaattcctcgaccatgacctacgcgaccgtggggagctcgtcgcttgacagcaccgccgcagccgcggcagccgcagccgccatgacagcgacgagactggcctcgagctatatgcccagcagcggtagcagcccctctgtgcccagttccatcatcgccgaggagaaactgctggccctgctggccgagctggaagccctgagccgccagctggccgccctgacccagcaggtgtccgatctccgcgagcaacagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagataatccagtcatagcaggggcgctgggcgtggtgctggatgatgtccttgaggaggagactgatggccacggggagccccttggtgtaggtgttggcaaagcggttaagctgggagggatgcatgcggggggagatgatgtgcagtttggcctggatcttgaggttggcgatgttgccacccagatcccgccgggggttcatattgtgcaggaccaccagaacggtgtagcccgtgcacttggggaacttatcatgcaacttggaagggaatgcgtggaagaatttggagacgcccttgtgcccgcccaggttttccatgcactcatccatgatgatggcaatgggcccgtgggctgcggctttggcaaaaacgtttctggggtcagagacatcataattatgctcctgggtgagatcatcataagacattttaatgaatttggggcgaagggtgccagattgggggacgatcgttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttcttaacagctgggacttgccgcacccggtcgggccgtagatgaccccgatgacgggttgcaggtggtagttcaaggagatgcagctgccgtcgtcccggaggaggggggccacctcgttgagcatgtctctcacttggaggttttcccggacgagctcgccgaggaggcggtccccgcccagcgagagcagctcttgcagggaagcaaagtttttcaggggcttgagcccgtcggccatgggcatcttggcaagggtctgcgagaggagctccaggcggtcccatagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagcttgtagttaagggcctcggcggcgtggcccttggcacggagcttgcctttggaagagcgcccgcaggcgggacagaggagggattgcagggcgtagagcttgggtgcgagaaagacggactcgggagcgaaggcgtccgctccgcagtgggcgcagacggtttcgcactcgacgagccaggtgagctcgggctgctcggggtcaaaaaccagttttcccccgttctttttgatgcgcttcttacctcgcgtctccatgagtctgtgtccgcgttcggtgacaaacaggctgtctgtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcctgccctgccgcaatgctttttaggagactttcatccatctggtcagaaaagactatttttttattgtcaagcttggtggcaaaggagccatagagggcgttggagagaagcttggcgatggatctcatggtctgatttttgtcacggtcggcgcgctccttggccgcgatgttgagctggacatactcgcgcgcgacacacttccattctgggaagacggtggtgcgctcgtcgggcacgatcctgacgcgccagccgcgattatgcagggtgaccaggtccacgctggtggccacctcgccgcgcaggggctcgttggtccagcagaggcgtccgcccttgcgcgagcagaacgggggcagcacatcaagcagatgctcgtcaggggggtccgcatcgatggtgaagatgcccggacagagttccttgtcaaaataatcgatttttgaggatgcatcatccaaggccatctgccactcgcgggcggccagcgctcgctcgtaggggttgaggggcggaccccagggcatgggatgcgtgagggcggaggcgtacatgccgcagatgtcgtagacatagatgggctccgagaggatgccgatgtaggtgggataacagcgccccccgcggatgctggcgcgcacatagtcatacaactcgtgcgagggggccaagaaagcggggccgagattggtgcgctggggctgctcggcgcggaagacgatctggcgaaagatggcatgcgagttggaggagatggtgggccgttggaagatgttaaagtgggcgtggggcaagcggaccgagtcgcggatgaagtgcgcgtaggagtcttgcagcttggcaacgagctcggcggtgacaaggacgtccatggcgcagtagtccagcgtttcacggatgatgtcataacccgcctcttctttcttctcccacagcgcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtatccctaaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccggaacggaggctcggttgttgatgacctgggcggcgaggacgatctcgtcgaagccgttgatgttgtgcccgacgatgtagagttccatgaatcgcgggcggcctttgatgtgcggcagctttttgagttcctcgtaggtgaggtcctcggggcattgcaggccgtgctgctcgagcgcccactcctggagatgtgggttggcttgcatgaatgaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcggggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggtcgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaaaacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcagtggcggtagaggcacgtcggcgtggcgctcgggcaggtcccggtgctgcgccctgagagcgctggcgtgcgcgacgacgcggcggttgacatcctggatctgccgcctttgcgtgaagaccacgggccccgtgactttgaacctgaaagacagttcaacagaatcaatctcggcgtcattgacggcggcctgacgcaggatctcttgcacgtcgcccgagttgtcctggtaggcgatctcggacatgaactgctcgatttcctcctcctggagatcgccgcggcccgcgcgctctacggtggcggcaaggtcattcgagatgcgacccatgagctgcgagaaggcgcccaggccgctctcgttccagacgcggctgtaaaccacgtccccgtcggcgtcgcgcgcgcgcatgaccacctgcgcgaggttgagctccacgtgccgcgcgaagacggcatagttgcgcaggcgttggaagaggtagttgagggtggtggcgatgtgctcggtgacgaagaagtacataatccagcggcgcaggggcatttcgctgatgtcgccaatggcctccagcctttccatggcctcgtagaaatccacggcgaagttgaaaaactgggcgttgcgggccgagaccgtgagctcgtcttccaggagcctgatgagttcggcgatggtggcgcgcacctcgcgctcgaaatccccgggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggtgggtccccgttgggcagcgatagggcgctgacaatgcatcttatcaattgcggtgtagggcacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgaacggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaagtgcagttggccataagcgaccagttgacggtctgcaggccgggttgcacgacctcggagtacctgagccgcgagaaggcgcgcgagtcgaagacatagtcgttgcaggtgcgcacgaggtactggtatccgactagaaagtgcggcggcggctggcggtagagcggccagcgctgggtggccggcgcgcccggggccaggtcctcaagcatgagtcggtggtagccgtagaggtagcgggacatccaggtgatgccggcggcggtggtggaggcgcgcgggaactcgcggacgcggttccagatgttgcgcaggggcaggaaatagtccatggtcggcacggtctggccggtgagacgcgcgcagtcattgatgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccaagcccgatagccgccaggatacggcggagagccctttttgtcggccgaggggagtcgctagacttgaaagcggccgaaaaccctgccgggtagtggctcgcgcccgtagtctggagaagcatcgccagggttgagtcgcggcagaacccggttcaaggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacatccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcacagctgttcctggtggtgcagcacagcagggacaacgaggcgttcagggaggcactgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtatgtgcccatagacaaggaggtgaagatagacagcttttacatgcgcatggcgctcaaggtgctgacgctgagcgacgacctgggcgtgtaccgcaacgaccgcatccacaaggccgtgagcacaagccggcggcgcgagctgagcgaccgcgagctgatgctgagtctgcgccgggcgctggtaggaggcgccaccggcggtgaggagtcctactttgacatgggggcggacctgcattggcagccgagccgacgcgccttggaggccgcctacggtccagaggacttggatgaggaagaggaagaggaggaggatgcacccgttgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggttccttctcggaccaaccccacgcacgagaaggtgctggcgatcgtgaacgcgctggcggagaacaaggccatccgtcccgacgaggccgggctagtgtacaacgccctgctggagcgcgtgggccgctacaacagcacaaacgtgcagtccaacctggaccggctggtgacggacgtgcgcgaggccgtggcgcagcgcgagcggttcaagaacgagggcctgggttcgctggtggcgctgaacgccttcctggcgacgcagccggcgaacgtgccgcgcgggcaggatgattataccaactttataagcgcgctgcggctgatggtgaccgaggtgccccagagcgaggtgtaccagtcgggcccggactactttttccagacgagcagacagggcctgcagacggtgaacctgagtcaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagtggcagcgtgaaccgcaactcgtacctgggtcacctgctgacgctgtaccgcgaggccataggccaggcgcaggtggatgagcagaccttccaggagatcactagcgtgagccgcgcgctgggtcagaacgacaccgacagtctgagggccaccctgaacttcttgctgaccaatagacagcagaagatcccggcgcagtacgcgctgtcggccgaggaggagcgcatcctgagatatgtgcagcagagcgtagggctgttcctgatgcaggagggggccacccccagcgccgcgctggacatgaccgcgcgcaacatggaacctagcatgtacgccgccaaccggccgtttattaataagctgatggactacctgcaccgcgcggcgtccatgaactcggactactttaccaatgccatcttgaacccgcactggctcccgccgccggggttctacacgggcgagtacgacatgcctgaccccaacgacgggtttttgtgggacgacgtggacagcgcggtgttctcaccgaccttgcaaaagcgccaggaggcggtgcgcacgcccgcgagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggtcaataacgggatagagagtctggtggacaaactgaaccgctggaaaacctacgctcaggaccatagggaacctgcgcccgcgccgcggcgacagcgtcacgaccggcagcggggcctggtgtgggacgacgaggactcggccgacgatagcagcgtgttggacttgggcgggagcggtggggccaacccgttcgcgcatctgcagcccagactggggcgacggatgttttgaatgcaaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtatttggtggacaacaagtcggcggacatcgcttccctgaactaccaaaacgaccacagcaacttcctgaccacggtggtgcagaacaacgatttcacccctgccgaggccagcacgcagacgataaattttgacgagcggtcgcggtggggcggtgatctgaagaccattctgcacaccaacatgcctaatgtgaacgagtacatgttcaccagcaagtttaaggcgcgggtgatggtggctagaaaaaaggcggaaggggctgatgcaaatgataggagcaaggatatcttagagtatcagtggtttgagtttaccctgcccgagggcaacttttccgagaccatgaccatagacctaatgaacaacgccatcttggaaaactacttgcaagtggggcggcaaaatggcgtgctggagagtgatatcggagtcaagtttgacagcagaaatttcaagctgggctgggacccggtgaccaagctggtgatgccaggggtctacacctacgaggccttccacccggacgtggtgctgctgccgggctgcggggtggatttcaccgagagccgcctgagcaacctcctgggcattcgcaagaagcaaccttttcaagagggcttcagaatcatgtatgaggacctagtagggggcaacatccccgctctcctgaatgtcaaggagtatctgaaggataaggaagaagctggcaaagcagatgcaaatactattaaggctcagaatgatgccgtcccaagaggagataactatgcatcagcggcagaagccaaagcagcaggaaaagaaattgagttgaaggccattttgaaagatgattcagacagaagctacaatgtgatcgagggaaccacagacaccctgtaccgcagttggtacctgtcctatacctacggggatcccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctttgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaaacgctcccagcagcaccccgtccgcgtccgcggtcacttccgcgctccctggggcgcttacaagcgggggcggacctctgctcctgccgccgtgcgcaccaccgtcgacgacgtcatcgactcggtggtcgccgatgcgcgcaactacacccccgccccctcgaccgtggacgcggtcatcgacagcgtggtggcagacgcgcgtgactatgccagacgcaagagccggcggcgacggatcgccaggcgccaccggagcacgcccgccatgcgcgccgcccgagctctgctgcgccgcgccagacgcacgggccgccgggccatgatgcgagccgcgcgccgcgctgccactgcacccacccccgcaggcaggactcgcagacgagcggccgctgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgtgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctaaagcccgtgaccctgcagcaggtgctgccccaggcagtgctgctgccgagccgcggggtcaagcgcgagggcgagagcatgtacccgaccatgcagatcatggtgcccaagcgccggcgcgtggaggacgtgctggacaccgtaaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgcgtccacttctaccgccgccacggctaccgagcctcccaggaggcgaagatggggcgccgccagccggctgatgcccaactacgtgttgcatccttccatcatcccgacgccaggctaccgcggcacccggtactacgccagccgcaggcgcccagccagcaaacgccgccgccgcaccgccacccgccgccgtctggcccccgcccgcgtgcgccgcgtgaccacgcggcggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagtggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcactgggcagttgttaagggaaaagctcaaagaccagaacttccagcaaaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaagggcgagaagcgaccgcggcccgacgcggaggagacaatcctgcaagtggacgagccgccctcgtacgaggaggccgtcaaggccggcatgcccaccacgcgcatcatcgcgccgctggccacgggtgtaatgaaacccgctacccttgacctgcctccaccacccacgcccgctccaccaaaagcagctccggttgtgcagccccctccggtggcgaccgccgtgcgccgcgtccccgcccgccgccaggcccagaactggcagagcacgctgcacagtatcgtgggcctgggagtgaaaagtctgaagcgccgccgatgctattgagagagagtaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacttactttgacatccgcggcgtcctggaccgcggcccaagcttcaaaccctactcgggcacggcttacaacagcctggcccccaagggcgcccccaatcccagtcagtggactaccaaagaaaagcaaaacggaggaactggagcagaaaaagatgttacaaagacatttggacttgccgccatgggaggcagtaatatttctaaagacggtttgcagattggaactgacaaaacagcaaatgctgaaaaaccaatctatgcagacaaaactttccagccagaacctcaagttggagaagaaaactggcaggataatgatgaatattatggcggcagggctcttaaaaaagataccaaaatgaagccatgctatggttcatttgctaaacccacaaacaaggaaggtgggcaggctaaattgaaagaaacacccaatggtaccgatcctcaatacgatgtggacatggctttctttgactcaagcactataaatataccagatgtggtgttgtacactgaaaatgtagatttggaaactccagatacacatgtggtgtacaaaccaggcaaagaggatgacagttctgaagctaatttaactcagcagtccatgcctaacagaccaaactacattggcttcagagacaactttgtggggctattgtactacaacagcactggcaacatgggtgtgctggctggtcaggcttctcagttgaatgccgtggtcgacttgcaagacagaaacaccgaactgtcttaccagctcttgctagattctcttggtgacagaaccagatattttagtatgtggaactctgcggtggacagctatgatcccgatgtcaggatcattgagaaccacggtgtggaagatgaacttcctaactattgcttccccttggacggtgttcaaactaattcagcctatcaaggtgttaaactaaagcctgatcaaacaggaggcggagttaatggagattgggtaaaggatgatgacatttcagcccataatcaaattggaaagggcaacatctttgccatggagatcaacctccaggccaacctgtggaagagttttctgtactcgaacgtggccctgtacctgcccgactcctacaagtacacgccggccaacgtcacgctgcccgccaacaccaacacctatgagtacatgaacggccgcgtggtagccccctcgctggtggacgcctacattaacatcggcgcccgctggtcgctggaccccatggacaacgtcaacccctttaaccaccaccgcaatgcgggcctgcgctaccgctccatgcttttgggcaatggccgctacgtgcccttccacatccaagtgccccaaaagttctttgccatcaagaacctgctcctgctccccggctcctacacctacgagtggaacttccgcaaggatgtcaacatgatcctgcagagttccctcggaaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatttccatcccctcgcgcaactgggccgccttccgcggctggagtttcacccggctcaagaccaaggaaactccctcccttggctcgggttttgacccctactttgtctactcgggctccatcccctacctcgacgggaccttctacctcaaccacaccttcaagaaggtttccatcatgttcgactcctcggtcagctggcccggcaacgaccggctgcttacgccgaacgagttcgagatcaagcgcagcgtcgacggggagggctacaacgtggcccaatgcaacatgaccaaggactggttcctcgtccagatgctctcccactacaacatcggctaccagggcttccatgtgcccgagggctacaaggaccgcatgtactccttcttccgcaacttccagcccatgagcaggcaggtggtcgatgagatcaactacaaggactacaaggcagtcaccctgcccttccagcacaacaactctggcttcaccggctacctggcacccaccatgcgtcaggggcagccctaccccgccaacttcccctacccgctcatcggctccaccgcagtgccatccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggcttcctcgccggcgacaagctggcctgcgccatcgtcaacacggccggccgcgagaccgggggcgtgcactggctcgcctttggctggaacccgcgctcgcgcacctgctacatgttcgaccccttcgggttctcggaccgccggctcaagcagatttacagcttcgagtacgaggccatgctgcgccgaagcgccctggcctcctcgcccgatcgctgtcttagcctcgaacagtccacccagaccgtgcaggggcccgactccgccgcctgcggactcttctgttgcatgttcttgcatgccttcgtgcactggcccgaccgacccatggacgggaaccccaccatgaacttgctgacgggggtgcccaacggcatgctacaatcgccacaggtgctgcccaccctcaggcgcaaccaggaggagctctaccgcttcctcgcgcgccactccccctactttcgctcccaccgcgccgccatcgaacacgccaccgcttttgataaaatgaaacaactgcgtgtatgactcaaataaacagcacttttattttacacatgcgctggagtatatgcaagttatttaaaagtcgaaggggttctcgcgctcgtcgttgtgcgccgcgctggggagggccacgttgcggtactggaacttgggctgccacttgaactcggggatcaccagtttgggcactggagtctcggggaaggtctcgctccacatgcgccggctcatttgcagggcgcccagcatgtcagggccggagatcttgaaatcgcagttgggaccggtgctctgcgcgcgcgagttgcggtacacggggttgcagcactggaacaccatcagactggggtacttcacactggcaagcacgctcttgtcgctaatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacgaaggccgcgatctgcttgaaagcttgctgggccttggccccctcgctaaaaaacaggccgcagctcttcccgctgaactggttattcccgcacccggcatcatgcacgcagcagcgcgcgtcatggctggtcagttgcaccacgctccgtccccagcggttctgggtcaccttagccttgctgggctgctccttcagcgcgcgctgtccgttctcgctggtcacatccatctccaccacgtggtccttgtgaatcatcaccgttccatgcagacacttgagctgaccttccacctcggtgcagccgtgatcccacaggacgcagccggtgcactcccaattcttgtgcgcgatcccgctgtggctgaaaatgtaaccttgcaacaggcgacccataatggtgctaaatgctttctgggtggtgaatgtcagttgcatcccgcgggcctcctcgttcatccaggtctggcacatcttctggaagatctcggtctgctccggcatgagcttgtaagcatcgcgcaagccgctgtcgacgcggtagcgttccatcagcacgttcatggtatccatgcccttctcccatgacgagaccagaggcagactcagggggttgcgcacgttcaggacaccaggggtcgcgggctcgacgatgcgttttccgtccttgccttccttcaacagaaccggaggctggctgaatcccactcccacgatcacggcgtcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggcggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctaaaacccccacaggatgaacaggagcacgagcaagacgcaggccaggaggagaccgacgctgggctcgagcatggctacctgggaggagaggaggatgtgctgctaaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggcccttgccacctatcacatctttttcaagaaccaaaagatccccatctcctgtcgcgccaatcgcactcgcgccgacgcgctcctcgctctggggcccggcgcgcgcatacctgatatcgcttccctggaagaggtgcccaagatcttcgaagggctcggtcgggacgagacgcgcgcggcaaacgctctgaaagaaacagcagaggaagagggttacactagcgccctggtagagttggaaggcgacaacgccaggctggccgtgcttaagcgcagcgtcgagctcacccatttcgcctaccccgccgtcaacctcccgcccaaggtcatgcgtcgcatcatggatcagctcatcatgccccacatcgaggcccttgatgaaagtcaggaacagcgccccgagaacgcccagcccgtggtcagcgacgagatgctcgcgcgctggctcgggacccgcgacccccaggccctggagcagcggcgcaagctcatgctggccgtggtcctggtcacccttgagctcgaatgcatgcgccgcttttttaccgaccccgagaccctgcgcaaggtcgaggagaccctgcactacactttcagacacggtttcgtcaggcaggcctgcaagatctccaacgtggagctgaccaacctggtctcctgcctggggatcctacacgagaaccgcttgggacagaccgtgctccactctaccctgaagggcgaggcgcggcgggactacatccgcgactgcgtctttctctttctctgccacacatggcaagcggccatgggcgtgtggcagcagtgtctcgaggacgagaacctgaaggagctggacaagcttcttgctagaaaccttaaaaagctgtggacgggcttcgacgagcgcaccgtcgcctcggacctggccgagatcgtcttccccgagcgcctgaggcagacgctgaaaggagggctgcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacattgcccaccactcggatgtgatcgaggacgtgagcggcgaggggctgctcgagtgccactgtcgctgcaacctatgctccccgcaccgctccctggtctgcaacccccagctactgagcgagacccaggtcatcggtacctttgagctgcaaggtccgcaggagtccaccgctccgctgaaactcacgccggggttgtggacttccgcgtacctgcgcaaatttgtacccgaggactactacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagacttggaagaggtggaagaggagcaggcaacagagcagcccgtcgccgcaccatccgcgccggcagcccctccggtcacggatacaacctccgcagctccggccaagcctcctcgtagatgggatcgagtgaagggtgacggtaagcacgagcgacagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggcctgaggatcgcggcgaacgagcccttgaccaccagggagctgaggaaccggatcttccccactctttatgccatttttcagcaaagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctgactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggcttagtgccggcccctcgatgatctcacgggtcaacggggtccgtaaccatcgaaaccagatattgttgcagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcaatcggtctgcgaccggacggagtgttccaactagccggagccgggagatcgtccttcactcccaaccaggcctacctgaccttgcagagcagctcttcggagcctcgctcgggaggcatcggaaccctccagttcgtggaggagtttgtgccctcggtctacttcaaccccttctcgggctcgccaggcctctacccggacgagtttataccgaacttcgacgcagtgagagaagcggtggacggctacgactgaatgtcctatggtgactcggctgagctcgctcggttgaggcatctggaccactgccgccgcctgcgctgctttgcccgggagagctacggcctcatctactttgagctgcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatttgtcctaccccgaagttgcatgagaatttttgttgtactctttgtggtgagtttaataaaagctaaactcttgcaatactctggaccttgtcgtcatcaactcaacgagaccgtctacctcaccaaccagactgaggtaaaacttacctgcagaccacacaagacctatatcatctggttcttcgagaacacctcatttgcagtctccaacactcactgcaacgacggtgttgaacttcccaacaacctttccagtggactgagttacaatacacgtagagctaagctcatcctctacaatccttttgtagagggaacctaccagtgccagagcggaccttgcttccacagttttactttggtgaacgttaccggcagcagcacagccgctccagaaactaaccttccttctgatactatcaaaccttgtttcggaggtgagctaaggcttcccccttctcaggagggggttagcccatacgaagtggtcgggtatttgattttaggggtggtcctgggtgggtgcatagcggtgctagctcagctgccttgctgggtggaaatcaaaatctttatatgctgggtaagacattgtggggaggaactatgaaggggctcttgctgattatcctttccctggtggggggtgtgctgtcatgccacgaacagccacgatgtaacatcaccacaggcaatgagaggaacgactgctctgtagttatcaaatgcgagcaccattgtcctctcaacattacattcaaaaataagaccatgggaaatgtatgggtgggattctggcaaccaggagatgagcagaactacacggtcactgtccatggtagcaatggcaatcacactttcggtttcaaattcatttttgaagtcatgtgtgatatcacactacatgtggctagacttcatggcttgtggccccctaccaaggataacatggtgggtttttctttggcttttgtgatcatggcctgcttgatgtcaggtctgctggtaggggctctagtgtggtttctgaaacgcaagcccaggtatggaaatgaagagaaggaaaaattgctataaattctttttctttttcgcagaaccatgaatacagtgatccgtatcgtgctgctctctcttcttgtagcttttagtcaggcaggatttcatactatcaatgctacatggtgggctaatataactttagtgggacccccagacacaccagtcacttggtatgatactcaaggattgtggttttgcaatggcagtagagttaagaatcctcaaatcagacatacatgtaatgatcaaaaccttactttgatccatgtgaacaaaacttatgaaagaacatacatgggttataatagacaagggactaaaaaagaagactacaaagttgtagttataccacctcctcctgctactgtaaaaccacagccagagccagagtatgtgtttgtttatatgggagagaacaaaactctagaaggtcctccgggaactccagtcacatggtttaatcaggatggaaagaaattttgtgaaggagaaaaagttcttcatccagaatttaaccacacctgtgacaaacaaaaccttatactactgtttgtgaattttacacatgatggagcttaccttgggtacaatcatcaaggaacccagagaacacactatgaagttacagtattagatctttttccagattctggccaaatgaaaattgaaaatcatagtgaggaaacagagcaaaaaaatgatgaacatcataactggcagaaacagggtgggcaaaaacagggtgggcaaaaaacaaatcaaacaaaagttaatgacaggagaaaaacagcgcaaaaaagaccatcaaagctaaagccggcaactattgaggcaatgctggttacagtgactgccgggtctaacttaactttggttggacctaaagcagaaggaaaagttacttggtttgatggagatttaaaaagaccatgtgagcctaattacagactaagacacgaatgtaataatcaaaacttaactctgattaatgtaactaaagattatgagggaacttactatggtacaaatgacaaagatgagggcaaaaggtacagagtgaaagtaaatactacaaattctcaatctgtgaaaattcagccatataccagacaaactactcctgatcaagagcacaaatttgaattacagttcgaaactaatggaaattatgattcaaaaattccctcaaccactgtggcaatcgtggtgggtgtgattgcgggcttcataactctgatcattgtcttcatatgctacatctgctgccgcaagcgtcccagggcatacaatcatatggtagacccactactcagcttctcttactaagactcagtcactttcatttcagaaccatgaaggctttcacagcttgcgttctgattagcctagtcacacttagtgtagctattaaaaatcaatatcatgttcataatgttaccagagatggatatatcacattaaatgtaacaattgataatactacctggacaagatatcatttaaataagtggcatcaaatttgtacgtggtcagacccatcatacaaatgtcacagcaatggcagcattaccattcatgctttcaatattacttctggccagtacaaagctgaaagttttactaactggtttagatattacggtaatcataaacatgaaattcatatttttaacataactgtaattgagcatcctacaacaaaagcacccaccactgctaatacagctacatcaattaaatcaacaaccacacagcctactactagggagacaactcaacctaccaccacagtcagtacaactactgagaccactactcaaactacacagctagacacaacagtgcagaatagcactgtgttggttaggtatctgttgagggaggaaagtactactgaacagacagaggctacctcaagtgcctttagcagcactgcaaatttaacttcgcttgcttggactaatgaaaccggagtatcattgatgaatcatcagcctttctcaggtttggatattcaaattacttttctggttgtttgtgggatctttattcttgtggttcttctgtactttgtctgctgcaaagccagagagaaatctaggaggcccatctacaggccagtaatcggggaacctcagccactccaagtggaagggggtctaaggaatcttcttttctctttttcagtatggtgatcagccatgattcctaggttcttcctatttaacatcctcttctgtctcttcaacatctgcgctgcctttgcagccgtctcgcacgcctcgcccgactgtctcgggcccttcccaacctacctcctctttgccctgctcacctgcacctgcgtctgcagcattgtctgcctggtcatcaccttcctgcagcttatcgactggtgctgtgcgcgctacaattatctccatcacagtcccgaatacagggacaagaacgtagccagaatcttaaggctcatctgaccatgcagactctgctcatgctgctatccctcctatcccctgccctagccacttatgctgattactctaaatgcaaattcgcagacatatggaatttcttagattgctatcaggaaaaaattgatatgccctcctattacttggtgattgtgggaatagtcatggtctgctcctgcactttctttgccatcatgatttacccctgttttgatctcggctggaactctgttgaagcattcacatacacactagaaagcagttcactagcctccacgccaccacccacaccgcctcctcgcagaaatcagttccccctgatacagtacttagaagagccccctccccgacccccttccactgttagctactttcacataaccggcggcgatgactgaccaccacctggacctcgagatggacggccaggcctccgagcagcgcatcctgcaactgcgcgtccgtcagcagcaggagcgggccgccaaggagctccttgatgccatcaacatccaccagtgcaagaagggcatcttctgcctggtcaaacaggcaaagatcacctacgagctcgtgtccaacggcaaacagcatcgccttacctatgagatgccccagcagaagcagaagttcacctgcatggtgggcgtcaaccccatagtcatcacccagcagtcgggcgagaccaacggctgcatccactgctcctgcgaaagccccgagtgcatctactcccttctcaagaccctttgcggactccgcgacctcctccccatgaactgatgttgattaaaagcccagaaaccaatcagacccttcctcatttccccatcccaatactcataagaataaatcattggaattaatcattcaataaagatcacttacttgaaatctgaaagtatgtctctggtgtagttgctcagcaacacctcggtaccctcctcccagctctggtactccagtccccggcgggcggcgaacttcctccacaccttgaaagggatgtcaaattcctggtccacaattttcattgtcttccctcttagatgtcaaagaggctccgggtggaagatgacttcaaccccgtctacccctatggctacgcgcggaatcagaatatccccttcctcactcccccctttgtctcctccgatggattcaaaaacttcccccctggggtactgtcactcaaactggctgatccaatcaccattaccaatggggatgtatccctcaaggtgggaggtggtctcactttgcaagatggaagcctaactgtaaaccctaaggctccactgcaagttaatactgataaaaaacttgagcttgcatatgataatccatttgaaagtagtgctaataaacttagtttaaaagtaggacatggattaaaagtattagatgaaaaaagtgctgcggggttaaaagatttaattggcaaacttgtggttttaacaggaaaaggaataggcactgaaaatttagaaaatacagatggtagcagcagaggaattggtataaatgtaagagcaagagaagggttgacatttgacaatgatggatacttggtagcatggaacccaaagtatgacacgcgcacactttggacaacaccagacacatctccaaactgcacaattgctcaagataaggactctaaactcactttggtacttacaaagtgtggaagtcaaatattagctaatgtgtctttgattgtggtcgcaggaaagtaccacatcataaataataagacaaatccaaaaataaaaagttttactattaaactgctatttaataagaacggagtgcttttagacaactcaaatcttggaaaagcttattggaactttagaagtggaaattccaatgtttcgacagcttatgaaaaagcaattggttttatgcctaatttggtagcgtatccaaaacccagtaattctaaaaaatatgcaagagacatagtttatggaactatatatcttggtggaaaacctgatcagccagcagtcattaaaactacctttaaccaagaaactggatgtgaatactctatcacatttaactttagttggtccaaaacctatgaaaatgttgaatttgaaaccacctcttttaccttctcctatattgcccaagaatgaaagaccaataaacgtgtttttcatttgaaattttcatgtatctttattgatttttacaccagcacgagtagacagtctcccaccaccagcccattttacagtgtacacggttctctcagcacgggtagccttaaatagggaaatattctcattagtgcgggaattggacttggggtctataatccacacagtttcctggcgagccaaacgggggtcggtgattgaaataaagccgtcctctgaaaagtcatccaagcgggcctcacagtccaaggtcacagtctggtggaacgagaagaacgcacagattcatactcggaaaacaggatgggtctgtgcctctccatcagcgccctcagcagtctctgccgccggggctcggtgcggctgctgcaaatgggatcgggatcacaagtctctctgactatgatcccaacagccttcagcatcagtctcctggtgcgacgggcacagcaccgcatcctgatctctgccatgttctcacagtaagtgcagcacataatcaccatgttattcagcagcccataattcagggcgctccagccaaagctcatgttgggaatgatggaacccacgtgaccatcgtaccagatgcgacagtatatcaggtgcctgcccctcatgaacacactgcccatgtacatgatctctttgggcatgtttctgtttacaatctggcggtaccaggggaagcgctggttgaacatgcacccgtaaatgactctcctgaaccacacggccagcagggtgcctcccgcccgacactgcagggagccaggggatgaacagtggcaatgcaggatccagcgctcgtacccgctcaccatttgagctcttaccaagtccagggtagcggggcacaggcacactgacatacatctttttaaaatttttatttcctctgtggtgaggatcatatcccaggggactggaaactcttggagcagggtaaagccagcagcacatggtaatccacggacagaacttacattatgataatctgcatgatcacaatcgggcaacaggggatgttgttcagtcagtgaagccctggtttcctcatcagatcgtggtaaacgggccctgcgatatggatgatggcggagcgagctggattgaatctcggtttgcattgtagtggattctcttgcgtaccttgtcgtacttctgccagcagaaatgggcccttgaacagcatatacccctcctacggccgtcctttcgctgctgccgctcagtcatccaactaaagtacatccattctcgaagattctggagaagttcctctgcatctgataaaataaaaaacccgtccatgcgaattcccctcatcacatcagccaggactctgtaggccatccccatccagttaatgctgccttgtctatcattcagagggggcggtggcaggactggaagaaccatttttattccaaacggtctcgaaggacgataaagtgcaagtcacgcaggtgacagcgttcccctccgctgtgctggtggaaacagacagccaggtcaaaacccactctattttcaaggtgctcgaccgtggcttcgagcagtggctctacgcgcacatccagcataagaatcacattaaaggctggccctccatcgatttcatcaatcatcaggttacattcctgcaccatccccaggtaattctcatttttccagccttggattatctctacaaattgttggtgtaagtccactccgcacatgtggaaaagctcccacagtgccccctccactttcataatcaggcagaccttcataatagaaacagatcctgctgctccaccacctgcagcgtgttcaaaacaacaagattcaataaggttctgccctccgccctgagctcgcgcctcaatgtcagctgcaaaaagtcacttaagtcctgggccactacagctgacaattcagagccagggctaagcgtgggactggcaagcgtaagggaaaactttaatgctccaaagctagcacccaaaaactgcatgctggaataagctctctttgtgtctccggtgatgccttccaaaatgtgagtgataaagcgtggtagtttttctttaatcatttgcgtaatagaaaagtcctctaaataagtcactaggaccccagggaccacaatgtggtagcttacaccgcgtcgctgaagcatggttagtagagatgagagtctgaaaaacagaaagcatgcactaaactaaggtggctattttcactgaaggaaaaatcactctctccagcagcagggtacccactgggtggcccttgcggacatacaaaaatcggtccgtgtgattaaaaagcagcacagtaagttcctgtcttcttccggcaaaaatcacatcagactgggttagtatgtccctggcatggtagtcattcaaggccataaatctgccctgatatccagtaggaaccagcacactcacttttaggtgaagcaataccaccccatgcggaggaatgtggaaagattcagggcaaaaaaattatatctattgctagccccttcctggacgggagcaatccctccaggactatctataaaagcatacagagattcagccatagcttagcccgcttaccagtagacagaaagcacagcagtacaagcgccaacagcagcaactgactacccactgacccagctccctatttaaaggcaccttacactgacgtaatgaccaaaggtctaaaaaccccgccaaaaaaaacacacacgccctgggtgtttttcacaaaaacacttccgcgttctcacttcctcgtatcgattttgtgactcaacttccgggttcccacgttacgtcacttctgcccttacatgtaacttggccgtatggcgccatcttgcccacgtccaaaatggctttcatgaccggccacgcctccgcgccggccgttagccgtgcgtcgtgacgttatttgcatcaccgcttctcgtccaatcagcgttggctccgccccaaaaccgttaaaattcaaaagctcatttgcatattaacttttgtttactttgtggggtatattattgatgatgc

SEQ ID NO: 30 - DNA, 35148 bp, Adenovirus D69
  MISC_FEATURE (1)..(35148): Complete Genome
catcatcaataatataccccacaaagtaaacaaaagttaatatgtaaatgagcttttgaatttagggcggggccgacgctgattggccgttgcaagaaccgttagtgacgtcacgacgcacggccgacggccgccgcggaggcgtggcctagtccggaagcaagtcgcggggctgatgacgtataaaaaagcggactttagacccggaaacggccgattttcccgcggccacgcccggatatgaggtaattctgggcggatgcaagtgaaattaggccattttggcgcgaaaactgaatgaggaagtgaaaagtgaaaaataccgggcccgcccagggcggaatatttaccgagggccgagagactttgaccgattacgtgggggtttcgattgcggtgttttttcgtgaatttccgcgtccgtgtcaaagtccggtgtttatgtcacagatcagctgatccacagggtatttaaaccagtcgatcccgtcaagaggccactcttgagtgccagcgagtagagatttctctgagctccgctcccagagtctgagaaaaatgagacacctgcgcctcctgtcttcaactgtgcctattgacatggccgcattattgctggaggattatgtgagtacaatattggaggacgaactgcatccatctccattcgagctgggacctacacttcaggacctatatgatttggaggtagatgcccatgatgacgacccgaacgaagaggctgtgaatttaatatttccagaatctctgattcttcaggctgacatagccagcgaagctgtacctacaccacttcatacaccgactctgtcacccatacctgaattggaagaggaggacgagctagacctccgatgttatgaggaaggttttcctcccagcgattcagaggacgaacagggtgagcagagcatgactctaatctcagaatatgcttgtgtggttgtggaagagcattttgtgttggacaatcctgaggtgcccgggcaaggctgtagatcctgccagtaccaccgggataagaccggagacacgaacgcctcctgcgctctgtgttacatgaaaaagaacttcagctttatttacagtaagtggagtaaatgtgagagagactgagtgcttaacacataactgggtgatgcttaaacagctgtgctaagtgtggtttatttttgtttctaggtccggtgtcagaggatgagtcatcaccctcagaagaagaccacccgtgtccccctgagctgtcaggcgaaacgcccctgcaagtgcacagacccaccccagtcagacccagtggcgagaggcgagcagctgttgaaaaaattgaggacttgttacatgacatgggtggggatgaacctttggacctgagcttgaaacgccccaggaactaggctcagctgtgcttagtcatgtgtaaataaagttgtacaataaaagtatatgtgacgcatgcaaggtgtggtttatgactcatgggcgtggcttagtcctatataagtggcaacacctgggcactggggcacagaccttcagggagttcctgatggatgtgtggactatccttgcagactttagcaagacacgccggcttgtagaggatagttcagacgggtgctccgggttctggagacactggtttggaactcctctatctcgtctggtgtacacagttaagaaggattataacgaggaaattgaaaatctttttgctgattgctctggcctgctagattctctgaatctcggccaccagtcccttttccaggaaagggtactccacagccttgatttttccagcccagggcgcactacagccggggttgcttttgtggtttttctggttgacaaatggagccagaacacccaactgagcaggggctacattctggacttcgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcttgtacccagagcttagcaaggtgctgacatccatggccaggggagtgaagagggagaggagcgatgggggcaataccgggatgatgaccgagctgacggccagcctgatgaatcgcaagcgcccagagcgcattacatggcacgagctacagatggagtgcagggatgagttgggcctgatgcaggataaatatggcctggagcagataaaaacacattggttgaacccagatgaggattgggaggaggccattaagaaatatgccaagatagccctgcgcccagattgcaagtacatagtgaccaagaccgtgaatattagacatgcctgctacatttcgggtaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttctttggcttcaacaatatgtgcgccgaggtctggggcgcttccaagatcaggggatgtaagttttatggctgttggatgggcgtagtgggaagacccaagagcgagatgtctgtgaagcagtgtgtgtttgagaaatgctacctgggagtctctaccgagggcaatgctagagtgagacactgctcttccctggatacgggctgtttctgcctggtgaagggtacggcctctctgaagcataatatggtgaagggctgcacagatgagcgcatgtacaacatgctgacctgcgactcgggggtctgccatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaggtccagggtgcgcgcttgcgagtgcgggggcagacacaccaggatgcagcctgtggccctggatgtgacagaggagctgagaccagaccacctggtgatggcctgtaccgggaccgagttcagctccagcggggaggacacagattagaggtaggtttgagtagtgggcgtggctaatgtgagtataaaggtgggtgtcttacgagggtctttttgcttttctgcagacatcatgaacgggaccggcggggccttcgaaggggggctttttagcccttatttgacaacccgcctgccgggatgggccggagttcgtcagaatgtgatgggatctacggtggatgggcgcccagtgcttccagcaaattcctcgaccatgacctacgcgaccgtggggaactcgtcgctcgacagcaccgccgcagccgcggcagccgcagccgccatgacagcgacgagactagcctcgagctacatgcccagcagcggtagcagcccctctgtgcccagttccatcatcgccgaggagaaactgctggccctgctggccgagctggaagccctgagccgccagctggccgccctgacccagcaggtgtccgagctccgcgagcagcagcagcaaaataaatgattcaataaacacagattctgattcaaaagcaaagcatctttattatttattttttcgcgcgcggtaggccctggtccacctctcccgatcattgagagtgcggtggattttttccaggacccgatagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccgcccagatcccgccgggggttcatgttgtgcaggaccaccaggacggtgtagcctgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcataattatgctcctgggtgagatcatcataagacattttaatgaatttggggcggagggtgccagattgggggactatggttccctcggggcccggggcgaagttcccctcgcagatctgcatctcccaggctttcatctcggaggggggaatcatgtccacctgcggggcgatgaaaaaaacggtttccggggcgggggtgatgagctgcgaggagaggaggtttctcagcagctgggacttgccgcacccggtcggaccgtagatgaccccgatgactggttgcaggtggtagttcaaggagatgcagctgccgtcgtcccggaggaggggggccacctcgttaagcatgtctctgacttggaggttttcccggacgagctcgccgaggaggcggtccccgcccagcgagaggagctcttgcagggaagcaaagtttttcaggggcttgagtccgtcggccatgggcatcttggcgagggtctgcgagaggagttccaaccggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaatgggtgggccccgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagctttcctttggaagagcgcccgcaggcgggacataggagggattgcagggcgtagagcttgggcgctagaaagacggactcgggggcgaaggcgtccgctccgcagtgggcgcagacggtctcgcactcgacgagccaggtgagctcggggtgatcggggtcaaaaaccagttttcccccgttctttttgatgcgcttcttacctcgcgtctccatgagtctgtgtccgcgttcggtgacaaacaggctgtctgtgtccccgtagacggacttgatgggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccacggtatgcagacacatgtccccctcctccgcatccaagaaggtgattggcttgtaggtgtaggccacgtgacctggggtccccgacgggggggtataaaagggggcgggtctgtgctcgtcctcactctcttccgcgtcgctgtctacgagcgccagctgttggggtaggtattccctctcgagagcgggcatgacctcggcactcaggttgtcagtttctagaaacgaggaggatttgatgttggcctgccctgccgcgatgcttttgagtaaactttcatccatctggtcagaaaagacaatttttttattgtcaagcttggtggcgaaggagccatagagggcgttggagagaagcttggcgatggatctcatggtctgatttttgtcacggtcggcgcgctccttggccgcgatgttgagctggacatactcgcgcgcgacgcacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatccaggaggtgctcgtcgggggggtccgcatcgatggtgaagatgcccggacagagttccttgtcaaaataatcgatttttgaggatgcatcatccaaggccatctgccactcgcgggcggccagcgctcgctcgtaggggttgaggggcggaccccaaggcatgggatgtgtgagggcggaggcgtacatgccgcagatgtcgtagacatagatgggctccgagaggatgccgatgtaggtgggataacagcgccccccgcggatgctggcgcgcacgtagtcatacaactcgtgcgagggggccaagaaggcggggccgagattggtgcgctggggctgctcggcgcggaagacgatctggcgaaagatggcatgcgagtttgaggagatggtgggccgttggaagatgttaaagtgggcgtggggcaggcggaccgagtcgcggatgaagtgcgcgtaggagtcttgcagcttggcgacgagctcggcggtgacgaggacgtccatggcgcagtagtccagtgtttcgcggatgatgtcataacccgcctctcctttcttctcccatagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcgaagccgttgatgttgtgcccgacgatgtagagttccatgaatcgcgggcggcctttgatgtgcggcagctttttgagttcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcacgctcccagcgatcccagcgtaagcgcacggcgagatcgcgagcgagggcgaccagctcggggtcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcatgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacaagggcgcgcagttgggagctgtccatggtgtcgcggagatccaggtcagggggcagggttctgaggttgacctcgtagaggcgggtgagggcgtgcttgagatgcagatggtacttgatttctacgggtgagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacttcggcgtggcgctcgggcaggtcccggtgctgcgccctgagagcgctggcgtgcgcgacgacgcggcggttgacatcctggatctgccgcctctgtgtgaagaccactggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctcgacggtggcggcgaggtcgttggagatgcgacccatgagctgcgagaaggcgcccaggccgctctcgttccagacgcggctgtagaccacgtccccgtcggcgtcgcgcgcgcgcatgaccacctgcgctaggttgagctccacgtggcgcgtgaagacagcgtagttgcgcaggcgttggaagaggtagttgagggtggtggcgatgtgctcggtgacgaagaagtacatgatccagcggcgcaggggcatctcgctgatgtcgccgatggcctccagcctttccatggcctcgtagaagtccacggcgaagttgaaaaactgggcgttgcgggccgagaccgtgagctcgtcttccaggagccggatgagctcggcgatggtggcgcgcacctcgcgctcgaaatccccgggggcctcctcctcttcctcttcttccatgacgacctcttcttctatttcttcctctgggggcggtggtggtggcggggcgcgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctttcaatgtcatcactggcggaggcagagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaggtgcagttggccatgagcgaccagttaacggtctgcaagccgggctgcacgacctccgagtacctgagccgcgagaaggcgcgcgagtcgaatacgtagtcgttgcaggtgcgcacgaggtactggtatccgactagaaagtgcggcggcggctggcggtagagcggccagcgctgggtggccggcgcgcccggggccaggtcctcgagcatgaggcggtggtagccgtagacgtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccaagcccgatagccgccaggatacggcggagagccctttttgccggccgaggggggtcgctagacttgaaagcggccgaaaaccctgtcgggcagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgagtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacgggcatcagccccgcgcgcgctcacgtggcggcggccaatctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctaacggcgcagctgttcctggtggtgcagcacagcagggacaacgaggcgttcagggaggcgctgctgaacatcgccgagcccgagggtcgctggctgctggagctgatcaacatcttgcagagcatcgtagtgcaggagcgcagcctgagcctggccgagaaggtggcggcgatcaactactcggtgttgagcctcggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctcatgctgagtctgcgccgggcgctggtagggggcgccgccggcggcgaggagtcctacttcgacatgggggcggacctgcattggcagccgagccggcgcgccttggaggccgcctatggtccagaggacttggatgaggaagaggaagaggaggaggatgcacccgttgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactttcggctattctggaggcggtggtcccctctcggaccaaccccacgcacgagaaggtgctggcgatcgtgaacgcgctggcggaaaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgttggtggcgctgaacgccttcctggcgacgcagccggcgaacgtgccgcgcgggcaggacgattataccaactttatcagcgcgctgcggctgatggtgaccgaggtgccccagagcgaggtgtaccagtcgggcccggactactttttccagactagcagacagggcctgcagacggtgaacctgagccaggctttcaagaatctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggtcacctgctgacgctgtaccgcgaggccataggccaggcgcaggtggacgagcagaccttccaggagatcactagtgtaagccgcgcgctgggtcagaacgacaccgacagtcttagagccaccctgaacttcttgctgacaaatagacagcagaagattccggcgcagtacgcgctgtcggccgaggaggagcgcatcctgagatatgtgcagcagagcgtagggcttttcctgatgcaggagggggccacccccagcgccgcgctggacatgaccgcgcgcaacatggaacctagcatgtacgccgccaaccggccgtttatcaataagctgatggactacctgcaccgcgcggcgtccatgaactcggactactttaccaatgccattttgaacccgcactggctcccgccgccggggttctacacgggcgagtacgacatgcctgaccccaacgacgggtttttgtgggacgacgtggacagcgcggtgttctcaccgaccttgcaaaagcgccaggaggcggtgcgcacgcccgcgagcgagggcgcggtgggtcggagcccctttcctagcttagggagtttgcatagcttgccgggctcggtgaacagcggcagggtgagccggccgcgcttgctgggcgaggacgagtacctgaacgattcgctgctgcagccgccgcgggtcaagaacgccatggccaataacgggatagagagtttggtggacaaactgaaccgctggaagacctacgctcaggaccatagggagcctgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcggcggatgttttgaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcagagctggctccgctgtacgacaccactcgcgtgtacttggtggacaacaagtcggcggacatcgcttccctgaactaccaaaacgaccacagcaacttcctgaccacggtggtgcagaacaacgatttcacccccgccgaggccagcacacaaacaataaattttgacgagcggtcgcggtggggcggtgatctgaagaccattctgcacaccaacatgcccaatgtgaacgagtacatgtttaccagcaagtttaaggcgcgggtgatggtggctagaaaaaaggcggaaggggctgatgcaaatgataggagcaaggatatcttagagtaccagtggtttgagtttaccctgcccgagggcaacttttccgagaccatgaccatagacctgatgaacaacgccatcttggaaaactacttgcaagtggggcggcaaaatggcgtgctggagagcgatattggagtcaagtttgacagcaggaatttcaagctgggctgggacccggtgaccaagctggtgatgccaggggtttacacctatgaggccttccacccggacgtggtgctgctgcctggctgcggggtggacttcaccgagagccgcctgagcaacctcctgggcattcgcaagaagcaacctttccaagagggcttcagaatcatgtatgaggatctagtagggggcaacatccccgccctcctgaatgtcaaggagtatctgaaggataaggaagaagctggcacagcagatgcaaataccattaaggctcagaatgatgcagtcccaagaggagataactatgcatcagcggcagaagccaaagcagcaggaaaagaaattgagttgaaggccattttgaaagatgattcaaacagaagctacaatgtgatcgagggaaccacagacaccctgtaccgcagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggttggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgcttccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttctaccgccgccgccgtgcgcaccaccgtcgacgatgtcatcgactcggtggtcgccgatgcgcgcaactatacccccgccccctccaccgtggacgcggtcatcgacagcgtggtggccgacgcgcgcgactatgccagacgcaagagccggcggcgacgaatcgccaggcgccaccggagtacgcccgccatgcgcgccgcccgggctctgctgcgccgcgccagacgcacgggccgccgggccatgatgcgagccgcgcgccgcgccgccactgcaccccccgcaggcaggactcgcagacgagcggccgccgccgccgccgcggccatttctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggacccccggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggccaggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgtctccacttctaccgccgccacggccaccgagcctcccaggaggcgaatatggggcgccgccagccggctgatgcccaactacgtgttgcatccttccatcatcccgacgccgggctaccgcggcacccggtactacgccagccgcaggcgcccagccagcaaacgccgccgccgcaccaccacccgccgccgtctggcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgattccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaagctcaaagaccagaacttccagcagaaggtggtggacgggctggcctcgggcattaacggggtggtggacatcgcgaaccaggccgtgcagcgcgagataaacagccgcctggacccgcggccgcccacggtggttgagatggaagatgcaactcttccgccgcccaagggcgaaaagcggccgcggcccgacgcggaggagacgatcctgcaggtggacgagccgccctcgtacgaggaggccgtgaaggccggcatgcccaccacgcgtatcatcgcgccgctggccacgggtgtaatgaaacccgccacccttgacctgcctccaccacccacgcccgctccaccgaaggcagctccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagtctggcccccaagggcgcccccaactccagtcagtgggaacagaaaaaggccaatgctggagatcaaaaggaaacacatacttatggtgtagctcctatgggtggagaaaacattacaattagcggtttgcaaattggaacagatactacaaatggcaaacaagacccgatatatgctaataagctgtatcaaccagagcctcaagtaggagaagaaaactggcaggaaacagaagccttctatggaggaagggctcttaaaaaggaaaccaagatgaaaccatgctatggctcatttgccagacccacaaatgaaaaaggaggacaggcaaaactaagagaccctgaaaaaagtcaagaagattttgacatagacctagcattctttgatactccgggaggaactttaacaggtggtggaacggaatacaaagcagacattgttatgtgcactgaaaatgttaatcttgaaaccccggacacccacgtggtgtataaaccaggcaaagatgatgacagttcagaaatcaacttggttcagcagtccatgcccaacagacctaactacatcggcttcagggacaactttgtgggtctcatgtactacaacagcactggcaacatgggtgtgctggccggtcaggcttctcagttgaatgctgtggtcgacttgcaagacagaaacacagagctgtcttaccagctcttgctagattctctgggcgacagaaccaggtactttagcatgtggaactctgcggtggacagctatgatcccgatgtcaggatcattgagaatcacggtgtggaagatgaacttcccaactattgcttcccattggatgggtctggcaccaatgctgcttatgaaggtgtaaaagttaaaaatggagaagatggggatcaagagagcgaatgggaaaaagacaccaatgtggcagatcgaaaccaaatatgcaagggcaacatctacgccatggagatcaacctccaggccaacctgtggaagagttttctgtactcgaatgtggccctgtacctgcctgactcctacaagtacacgccggccaacgtcacgctgcccgccaacaccaacacctacgagtacatgaacggccgcgtggtagccccctcgctggtggacgcctacatcaacatcggcgcccgctggtcgttggaccccatggacaacgtcaaccccttcaaccaccaccgcaatgcgggcctgcgctaccgctccatgcttctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggaaacgatctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaggaaactccctccctcggctcgggtttcgacccctactttgtctactcgggctccatcccctatctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaatgtggcccaatgcaacatgaccaaggactggttcctcgtccagatgctctcccactacaacatcggttaccagggcttccatgtgcccgagggctacaaggaccgcatgtactccttcttccgcaacttccagcccatgagcaggcaggtggtcgatgagatcaactacaaggactacaaggccgtcaccctgcccttccagcacaacaactctggcttcaccggctacctcgcacccaccatgcgtcaggggcagccctaccccgccaacttcccctacccgctcatcggccagacagccgtgccatccgtcacccagaaaaagttcctctgcgacagggtcatgtggcgcatccccttctccagcaacttcatgtccatgggcgcccttaccgacctgggtcagaacatgctctacgccaactcggcccacgcgctcgacatgacctttgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgcctttggctggaacccgcgctcgcgcacctgctacatgttcgacccctttgggttctcggaccgccggctgaagcagatttacagcttcgagtacgaggccatgctacgccgcagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctacccaccctccggcgcaaccaggagcagctctaccgcttcctcgcgcgccactccccttactttcgatcccaccgcgccgccatcgaacacgccaccgcttttgataaaatgaaacaactgcgtgtatctcaataaacagcacttttattttacatgcactggagtatatgcaagttatttaaaagtcaaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccgggccggagatcttgaaatcgcagttggggccggtgctttgcgcgcgcgagttgcggtacacggggttgcagcactggaacaccatcagactggggtacttcacactggcaagcacgctcttgtcgctgatctgatccttgtccaggtcctcggcgttgctcaggccgaacggggtcatcttgcacagctggcggcccaggaagggcacgctctgaggcttgtggttacactcgcagtgaacgggcattagcatcattcccgcgccgcgctgcatattcgggtagagggccttgacaaaggccgcgatctgcttgaaagcttgctgggccttggccccctcgctgaaaaacaggccgcagctcttcccgctgaactggttattcccgcatccggcatcctgcacgcagcagcgcgcgtcatggctggtcagttgcaccacgctccggccccagcggttctgggtcaccttggccttgctgggttgctccttcaacgcgcgctgcccgttctcactggtcacatccatctccaccacgtggtccttgtggatcatcaccgttccatgcagacacttgagctgaccttccacctcggtgcagccgtggtcccacagggcgcagccggtgcactcccagttcttgtgcgcgatcccgctgtggctgaagatgtaaccttgcaacatgcggcccattatggtgctaaaggttttctgagtggtgaaggtcagttgcagaccgcgggcctcctcgttcatccaggtctggcacatcttttggaagatctcggtctgctcgggcatgagcttgtaagcatcgcgcaggccgctgtcgacgcggtaacgttccatcagcacgttcatggtatccatgcccttctcccaggacgagaccagaggcagactcagggggttgcgcacgttcaggacaccgggtgtcgcgggctcgacgatgcgttttccgtccttgccttccttcaacagaaccggcggctggctgaatcccactcccacgatcacggcatcttcctggggcatctcttcgtcggggtctaccttggtcacatgcttggtcttcctggcttgcttcttttttggagggctgtccacgggaaccacgtcctcctcggaagacccggagcccacccgctgatactttcggcgcttggtgggcagaggaggtggtggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggaggagaccgacgctgggctcgagcatggctacctgggaggagaggaggatgtgctgctgaaacacctgcagcgccagtccatcatcctccgggacgccctggccgaccggagcgaaacccccctcagcgtcgaggagctaagtagggcctacgagctcaacctcttctcgccgcgcgtgccccccaaacgccagcccaacggcacatgcgagcccaacccgcgtctcaacttctaccccgtctttgcggtccccgaggccctcgccacctatcacatctttttcaagaaccaaaagatccccgtctcctgccgcgccaaccgcacccgcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggctcagtgccggcccctcgatgatctcacaggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagcttaacgacgagttggtgagctcttcaatcggtctgcgaccggacggagtgttccaactagccggagccgggagatcctccttcactccccaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgatgcagtgagagaagcggtggacggctacgactgaatgtcccatgctgactcggctgagctcgctcggttgaggcatctggaccactgccgccgcctgcgctgcttcgcccgggagagctgcggactcatctactttgagtttcccgaggagcaccccaacggccctgcgcacggagtgcggatcaccgtagagggcaccgccgagtctcacctggtcaggttcttcacccagcaacccttcctggtcgagcgggaccggggcgccaccacctacaccgtctactgcatctgtcctaccccgaagttgcatgagaatttttgttgtactctgtgtgctgagtttaataaaagctaaactcctacaatactctgggatcccgtgtcgtcgcactcgcaacgagatcttcaacctcaccaaccagactgaggtaaaactcaactgcagaccggggggcaaatacatcctctggctctttgaaaacacttccttcgcagtctccaacgcctgcgccaacgacggtattgaaatacccaacaaccttaccagtggactaacttacactaccagaaagactaagctagtactctacaatccttttgtagagggaacctaccactgccagagcggaccttgcttccacactttcactttggtgaacgttaccgacagcagcacagtcgctccagaaacatctaacctttttgatactaacactcctaaaaccggaggtgagctctgggttccctctttaacagaggggggtaaacatattgaagcggttgggtatttgattttaggggtggtcctgggtgggtgcatagcggtgctgtattaccttccttgctggatcgaaatcaaaatctttatctgctgggtcatacattgttgggaggaaccatgaaggggctcttgctgattatcctttccctggttgggggtgtactgtcatgccacgaacagccacgatgtaacatcaccacaggcaatgagaggagtgtgatatgcacagtagtcatcaaatgcgagcatgcatgtcctctcaacatcacattcaagaataagaccatgggaaattcatgggtgggcgattgggaaccaggagatgagcagaactacacggtcactgtccatggtagcgatgggaatcacactttcggtttcaaattcatttttgaagtcatgtgtgatatcacactgcatgtggctagacttcatggcttgtggccccctaccaaggagaacatggttgggttttctttggcttttgtgatcatggcctgctttatgtcaggtctgctggtaggggctttagtatggttcctgaagcacaagcctaggtatggaaatgaggagaaggaaaaattgctataaatctttttctcttcgcagaaccatgaatactttgaccagtgtcgtgctgctctctcttcttgtagcttttagtcaggcaggatttcatactatcaatgctacatggtgggctaatgtaactttagtgggaccctcagatacgccagtcacatggtatgataaacagggaatgcagttctgtgatggaaatacagttaagaatcctcaaataagacatgagtgtaatgagcaaaaccttacactaattcatgtgaacaaaacccatgaaaggacatacatgggttataatagacagagtactcataaggaagactataaagtcatagttataccgcctcctcctgctactgtaaagccacagtcaggtccagagtatgtatatgttaatatgggagagaacaaaaccttagttggacctccaggaataccagttacttggtatgacggagaaggaaataaattctgcgatggagaaaaagttgaacatgcagaatttaatcatacatgtgacgagcaaaatcttacactgttgtttataaatcttacacatgatggggcttatcttggctataatcaccagggaactaaaagaacttggtatgaggttgtagtgacagatggttttccaaaatcaggggagatgaaaatcgaagatcagagtagacaaacagaacaaaaacaaaatgagcataaacagggtgggcagaaacaggaggggcaaaaagagacaagtcaaaagaaagataatgacaaacagaaggcgacacacaggaggccatcaaaactaaagccgcacacacctgaagcaaaactgattacagtttctagtgggtctaacttaacattacttgggccagatggaaaggtcacttggtatgatgatgatttaaaaagaccatgcgagcctgggtataagttagggtgtaagtgtgacaatcaaaacctaacgctaatcaatgtaactaaactttatgagggagtttactatggtactaatgacagaggtaacagcaaaagatacagattaaaagtaaacactactaattctcaaagtgtgaaaattcagccatacaacaggtctactactcctgatcagaaacacagatttgaattgcaaattgattctaatcaagacaatgacaaaattccatcaaccactgtggcaatcgtggtgggagtgattgcgggcttcataactataatcattgtcattctgtgctacatctgctgccgcaagcgtcccagggcatacaatcatatggtagacccactacttagcttctcttactgagactcagtcactttcatttcagaaccatgaaggctttcacagcttgcgttctgattagcatagtcacattagtatcagctgattacaaacaagttcaagttagcagaggaggaaatattacattagatggaccattcgataatactacatggacaagatatcataatgatggacataaaaatggttggatgaaaatttgcacatggactggagcaacatataaatgtcacaataatggaagcattactatttttgctttcaacattacatccggagtttacaaagcagaagggtataaaaaagaggttagaacattttcatctagaaatcaaaaacatacaattgaagattctggagattatgaacaacaaaaaatatatctatataatctaacaataattgaagcgccaactactaaagcacccaccacagttagaacaaccacgcagacaactactagggaaacaacacatccaaccaccacagtcagtacaactcacactacacatctagacactacagtgcagaatactactttattgattgggtttttactaagaggaaatgaaagtactactgatcagacagaggctacctcaagtgccttcagcagcactgcaaatttaacttcgcttgcttcggtaaatgaaacgatcgtgccgatgatgtatggccaaccttactcaggtttggatattcaaattacttttctggttgtctgtgggatctttattcttgtggttcttttgtactttgtctgctgcaaagccagagaaaaatctaggaggcccatctacaggccagtaatcggggatcctcagcctctccaagtggaagggggtctaaggaatcttctcttctctttttcagtatggtgattcagccatgattcctaggttcttcctatttaacatcctcttctgtctattcaacgtgtgcgctgccttcgcggccgtctcgcacgcctcgcccgactgtcttgggcccttccccacctaccttctttttgccctgctcacctgcacctgcgtctgcagcattgtctgcctggtcgtcaccttcctgcagctcatcgactggtgctgcgcgcgctacaattatctccaccacagtcccgaatacagggacgagaacgtagccagaatcttaaggctcatttgaccatgcagactctgctcatactgctatccttcctctcccctgccctcgctgatgatgattactctaagtgcaaatttgtggagctatggaatttcttagactgctatgatgctaaaatggatatgccatcctattacttggtgattgtggggatagtcatggtctgctcctgcactttctttgccatcatgatctacccctgttttgatctcggctggaactctgttgaggcattcacatacacactagaaagcagttcactagcttccacgccgccacccacaccgcctccccgcagaaatcagtttcccatgattcagtacttagaagagccccctccccggcccccttccactgttagctactttcacataaccggcggcgatgactgacaaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctcctcaagaccctttgcggacttcgcgacctcctccccatgaactgattgattaaagcccaaaaaaccaatcaaaccccttcccattagccccaaataaacaatcattggaaataatcattcaataaagatcacttacttgaaatctgaaagtatgtctctggtgtagttgtttagcagcacctcggtaccctcctcccagctctggtactccagtccccggcgggcggcgaactttctccacaccttgaaagggatgtcaaattcctggtccacaattttcattgttttccctctcagatgtcaaagaggcttcgggtggaagatgacttcaaccccgtctacccctatgactacgcgcggaatcagaatatccccttcctcactcccccctttgtctcctccgatggattccaaaacttcccccctggtgtcctgtcactcaaattggctgacccaatcgctatcaccaatggtgatgtctcactcaaggtgggagggggacttactttacaagatggaaccggaaaactaactatcgacaccaagactcccttgcaagttgcaaataataaattagaacttgcgtttgatgcaccattgtatgaaaaaaatggaaaacttgctttaaaaacaggccatggattagctgttttaaccaaagacattggcataccagaattaattggatcccttgtgatcttaactggaaaaggaattgggacaggtactgttgcaggaggaggaactatagatgtaagactgggtgatgatggaggtttatcatttgataaaaagggtgatctagtagcctggaataaaaaaaatgacaggcgcactttgtggacaacacctgatccatccccaaactgcagagtatcagaagataaagattcaaaactaactttaattcttacaaaatgtggaagtcagatcctagcaagtttttcactgcttgtagtcaaagggacgtatgcaactgttgataaaaatacaactaataaacaatttagcattaaactactgtttgatgcaaatggaaagcttaaaagcgaatcaaaccttagtggttattggaactatagaagtgataatagtgttgttagtactccctatgacaatgcagtgcctttcatgccaaataccacggcttatccaaaaatcattaatagtacaactgatcctgaaaataagaaaagttcggctaaaaaaactattgttggcaatgtctacctagaaggtaatgcgggtcaaccagtagccgttgctattagtttcaataaggaaactactgctgactattcaataacatttgactttgcgtggagcaaagcttatgaaacccctgtgccttttgacacctcctccatgacattctcatatattgcccaggaaaatcaagacaaaggcgaataaagtgttttgaaatgaacttatgtatctttattgatttttacaccagcacgggtagtcagtctcccaccaccagcccatttcacagtgtacacgattctctcagcacgggtggccttaaatagggaaatgttctgattagtgcgggaactggacttggggtctataatccacacagtttcctggcgagccaaacgggggtcggtgattgagatgaagccgtcctctgaaaagtcatccaagcgggcctcacagtccaaggtcacagtctagtggaatgagaagaacgcacagattcatattcggaaaacaggatgggtctgtgcctctccatcagcgccctcagcagtctctgccgccggggctcggtgcggctgctgcagatgggatcgggatcacaagtctctctgactatgatccccacagccttcagcatcagtctcctggtgcgtcgggcacagcaccgcatcctgatctcgctcatgttctcacagtaagtgcagcacataatcaccatgttattcagcagaccataattcagggtgctccagccaaaactcatgttggggatgatggaacccacgtgaccatcgtaccagatgcggcagtatatcaggtgcctgcccctcatgaacacactgcccatatacatgatctctttgggcatgtctctgttcacaatctgacggtaccatgggaaacgctggttgaacatgcacccgtaaatgactctcctgaaccacacggccagcagggtgcctcccgcccgacactgcagggagcccggggatgaacagtggcaatgcaggatccagcgctcgtacccgctcaccatctgagctctcaccaagtccagggtagcggggcacaggcacactgacatacatctttttaaaatttttatttcctctggagtcaagatcatatcccaggggactggaaactcttggagcagggtaaagccagcagcacatggtaatccacggacagaacttacattatgataatctgcatgatcacaatcgggcaacaggggatgttgttcagtcagtgaagccctggtttcctcatcagatcgtggtaaacgggccctgcgatatggatgatggcggagcgagctggattgaatctcggtttgcattgtagtggattctcttgcgtaccttgtcgtacttctgccagcagaaatgggcccttgaacagcagatacccctcctgcggccgtcctttcgctgctgccgctcagtcatccaactgaagtacatccattctcgaagattctggagaagttcctctgcatctgatgaaataaaaaacccgtccatgcgaattcccctcatcacatcagccaggactctgtaggccatccccatccagttaatgctgccttgtctatcattcagagggggcggtggcaggattggaagaaccatttttattccaaacggtctcgaaggacgataaagtgcaagtcacgcaggtgacagcgttccccgccgctgtgctggtggaaacagacagccaggtcaaaacccactctattttcaaggtgctcgaccgtggcttcgagcagtggctctacgcgtacatccagcataagaatcacattaaaggctggccctccatcgatttcatcaatcatcaggttacattcctgcaccatccccaggtaattctcatttttccagccttggattatctctacaaattgttggtgtaagtccactccgcacatgtggaaaagctcccacagtgccccctccactttcataatcaggcagaccttcataatagaaacagatcctgctgctccaccacctgcagcgtgttcaaaacaacaagattcaataaggttctgccctccgccctgagctcgcgcctcaatgtcagctgcaaaaagtcacttaagtcctgggccactacagctgacaattcagagccagggctaagcgtgggactggcaagcgtaagggaaaactttaatgctccaaagctagcacccaaaaactgcatgctggaataagctctctttgtgtctccggtgatgccttccaaaatgtaagtgataaagcgtggtagtttttctttaatcatttgcgtaatagaaaagtcctgtaaataagtcactaggaccccagggaccacaatgtggtagcttacaccgcgtcgctgaagcatggttagtagagatgagagtctgaaaaacagaaagcatgcactaaactaaggtggctattttcactgaaggaaaaatcactctctccagcaacagggtacccactgggtggcccttgcggacatacaaaaatcggtccgtgtgattaaaaagcagcacagtaagttcctgtcttcttccggcaaaaatcacatcggactgggttagtatgtccctggcatggtagtcattcaaggccataaatctgccctgatatccagtaggaaccagcacactcacttttaggtgaagcaataccaccccatgcggaggaatgtggaaagattcagggcaaaaaaaattatatctattgctagtcccttcctggacgggagcaatccctccaggactatctataaaagcatacagagattcagccatagctcagcccgcttaccagtagacagagagcacagcagtacaagcgccaacagcagcgactgactacccactgacccagctccctatttaaaggcgccttacactgacgtaatgaccaaaggtctaaaaaccccgccaaaaaaaaacacacacgccctgggtgtttttcgcgaaaacacttccgcgttctcacttcctggtatcgatttggtgacttaacttccgggttcccacgttacgtcacttctgcccttacatgtaactcagtcgtagggcgccatcttgcccacgtccaaaatggattccatgtccagccacgcctccgcggcgaccgttagccgtgcgtcgtgacgtcatttgcatcaacgtttctcggccaatcagcagtagccccgccctaaatttaaaacctcatttgcatattaacttttgtttactttgtggggtatattattgatgatg

SEQ ID NO: 31 - DNA, 35993 bp, Adenovirus E4
  MISC_FEATURE (1)..(35993): Complete Genome
atcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtaggtgtcagctgatcgtcagggtatttaaacctgcgctctgcagtcaagaggccactcttgagtgccagcgagaagagttttctcctccgcgccgcgagtcagatctacactttgaaatatgaggcacctaagagacctgcccgatgaggaaattatcatcgcttccgggagcgagattctggaactggtggtaaatgctatgatgggcgacgaccatccggaaccccccaccccatttgagacaccttcgctgcacgatttgtatgatctggaggtggatgtgcccgaggacgaccccaacgagaaggcggtaaatgatttatttagcgatgccgcgctgctagctgccgaggaggcttcaagccctagctcagacagcgactcttcactgcatacccctagacacgacagaggtgagaaagagatccccgggcttaaatgggaaaagatggacttgcgttgctatgaggaatgcctgcccccaagcgatgatgaggacgagcaggcgattcagaacgcagcgagccatggagtgcaagccgtcagcgagagctttgcactggactgcccgcctttgcccggacacggctgtaagtcttgtgaatttcatcgcatcaatactggagataaagctgtgttatgtgcactttgctatatgagagcgtacaaccattgtgtttacagtaagtgtgattaagtgaactttaaagggaggcaaagagtagggtgactgggtgatgactggtttatttatgtatatctgttttttatataggtcccgtttctgacgcagatgatgagacccccactacagagtccactttgtcaccccctgaaattggcacgtctccatctgacaatattgttagaccagttcctgtaagagccactgggaggagagcagctgtagaatgtttggatgatttgcttcagggtggagatgaacctttggacttgtgtacccggaaacgccccaggcattaagtgccacacatgtgtgtttacttgaggtgatgtcagtatttatagggtgtggagtgcaataaaatatgtgttgactttaagtgcgtggtttatgactcaggggaggggactttgggtatataagcaggtgcagacctgtgtggttagctcagagcggtatggagatttggacggttttggaagactttcacaagactaggcagctgctagagaacgcctcgaacggagtctcttacctgtggagattctgcttcggcggtgacctagctaagctagtctatagggccaaacaggattatagggaacaatttgaggatattttgagagagtgtcctggtctttttgacgctcttaacttgggccatcagtctcactttaaccagagaatttcaagagcccttgactttactactcctggcagaaccactgcagcagtagccttttttgcttttatttttgacaaatggagtcaagaaacccatttcagcagggattaccagctggatttcttagcagtagctttgtggagaacatggaagtgccagcgcctgaatgcaatctccggctacttgccggtacagccgctagacactctgaggatcctgagtctccagcagcaggaggatcaagaagagaatccgagagccggcctggaccctccggcggaggagtagctgacctgtttcctgaactgcaccgggtgctgactaggtcttcgagtggtcgggagaggggtattaagcgggagaggcatgatgagactaatcacagaattgaactgactgtgggtctgatgagccgcaagcgtccagaaacagtgtggtggtatgaggtgcagtcaactggcacagatgaggtgtcagtcatgcatgagagattttccctagaacaagtcaagacttgttggttggagcctgaggatgattgggaggtagccatcaggaattatgccaagctggctctgaggccagatagaaagtacaagattactaagctgataaatatcagaaatgcctgctacatctcagggaatggggctgaagtggagatctgtctccaggatagagtggctttcagatgctgcatgatgaatatgtacccgggagtggtggacatggatggggtcacctttatgaacatgaggttcaggggagatgggtataatgggacggtctttatggccaataccaagctgacagtgcatggatgctccttctttgggtttaataacacctgcatcgaggcttggggtcaggtcggtgttaaggggtgcagtttttcagccaactggatgggggtagtgggcaggaccaagagtatgctgtctgtgaagaaatgcttgtttgagaggtgccacctgggggtgatgagcgagggcgaagccagaatccgccactgtgcctctaccgagacgggctgttttgtgctgtgcaagggcaatgccaagatcaagcataatatgatctgtggagcctcggacgagcgcggctaccagatgctgacctgcgccggtgggaacagtcatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagtaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcctacccacgatgtgaccaccgaccgcagccagcggctgacgctgcgctttgtgcccgtggaccgggaggacaacacctactcgtacaaagtgcgctacacgctggccgtgggcgacaaccgcgtgctggacatggccagcacctactttgacatccgcggcgtgctggatcggggccctagcttcaaaccctactccggcactgcctacaacagcctggctcccaagggagcgcccaacacctgccagtggaaggattctgacagcaaaatgcatacctttggggcagctgccatgcccggtgttactgggaaaaagatagaagctgatgggctgcctattagaatagattcaacttctggaactgacacagtaatttatgctgataaaactttccaaccagaaccacaagttggaaatgacagttgggttgacaccaatggtgcagaggaaaaatatggaggcagagctctaaaggacactacaaaaatgaaaccctgttatggttcattcgccaagcctaccaacaaagaaggtggtcaggctaacttaaaagattcagaacccgccgccaccactcctaactatgatatagacctggctttctttgacagcaaaactattgttgctaactacgatccagatattgtaatgtacacagaaaatgttgacttgcagactccagatactcatattgtatacaaacctggaacagaggacaccagctctgaatccaatttgggtcagcaggccatgcctaacagacccaactacattggcttcagagacaattttatcgggctcatgtactacaacagcactggcaatatgggggtgctggccggtcaggcctctcagctgaatgctgtggttgacttgcaagacagaaacactgaactgtcctaccagctcttgcttgactctctgggtgacagaacccggtatttcagtatgtggaatcaggcggtggacagctatgatcctgatgtgcgcattattgaaaaccatggtgtggaggatgaattgccaaactattgctttccgttgaatggtgtgggattgacagacacttaccagggtgttaaagttaaaacagatgcaggttctgaaaagtgggacaaagatgacaccacagttagtaatgctaatgaaatccatgtaggcaatccttttgccatggaaatcaacatccaagccaacctgtggaggaacttcctctatgccaatgttgccctctatttgcctgataaatacaaatacacaccggccaacatcaccctgcccaccaacaccaacacctacgagtacatgaacggccgggtggtggcgccctcgctggtggacgcctacattaacattggggcgcgctggtcgctggaccccatggacaacgtaaatcccttcaaccaccaccgcaatgcgggcttgcgctaccgctccatgctcctgggcaacgggcgctacgtgccattccacatccaggtgccccagaaattttttgccattaagagcctcctgctcctgcccgggtcctacacctacgagtggaacttccgcaaggacgtcaacatgatcctgcagagttcccttggcaacgacctgcgcacagacggggcctccatcaccttcaccagcattaacctctacgccaccttcttccccatggcgcacaacaccgcctccacgcttgaggccatgctgcgcaacgacaccaatgaccaatccttcaacgactacctctcggcggccaacatgctctatcccatcccggccaacgccaccaacgtgcccatctccatcccctcgcgcaactgggccgcctttcgcggctggtccttcacgcgactcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctcgttgaatctaataccacccacaccggaggtgagctccgaggtcctcagtcatctgggatttattacggtccctgggaggtggtggggttaatagctttaggcttagtagcgggtgggcttttggctctttgctacctatacctcccttgcttttcctacttagtggtgctttgttgctggtttaagaaatggggaagatcaccctagtgtgcggtgtgctggtggcggtactttcgattttgggtctgggcagcgcggctgtagtgacggagaaggccgatccctgcttgacttttaaccccgacaaatgccagctgagttttcagccagatggcaatcggtgcgcggtgttgattaagtgcggatgggaatgccagagcgtggcgatccagtataaaaacaagacgcggaacaatactctcgcgtccacatggcagcccggggaccccgagtggtacaccgtctctgtccctggtgctgacggcttccttcgcacggtaaacaacacttttatttttgagcacatgtgcaataccgccatgttcatgagcaggcagtaccatatgtggcccccacggaaagagaatatcgtggtcttctccatcgcttacagcttgtgcacggtgctaatcaccgcgatcgtgtgcctgagcattcacatgctcatcgctattcgccccagaaataatgctgagaaagagaaacagccataacaccattttttcacacacctttttcagaccatggcctctgttacagccattatttattttttgggtcttctgggatttatcaacagttttgaccataaaaacgtaactgcttatgttggttctaactgtgtactaactgggtaccagtcacaccaacgggtttcatggtactggtttgataaaaaaaacacagcttatacactttgcaaaggtaatcagcggcccacacagcgcagtggtctttattacagctgcactaataataatatcacactacttcaagtgactaaacaatattctgggacatactatggaaccaattttaacacggaacaggacacttactatagtgtcaaagtattggatccaactactcccagaactactaccaaacataccacaactaaaaagcccactatacctaaaaccactaaattaacaaccacaaccagcaccacacttgctgtgacctcacaggcaactactgaaaacgaattggttgccctgttgcagaatggggagaataatagcagcagtcctctgcctaccacccccagtgagcaaattcccagatccatgattggcattatcgctgctgtggtggtgtgtatggtcattatcatcttgtgcatgatgtactatgcctgctactacagaaaacacagactgaacaacaagctggacccctactgaattttgatttttaattacaaattaattgtggttgatcccactacacctccacccaccacaactaccacagacacacaagaacccactccagaggcagtagcagagttagcaaagcagatttatgaagattcctttgttgctaatactcccacacacctcggaccgcaatgtccagggttagtagtcagcggcatcgtcggtgtgctttgtgggttagcagttataatcatctgcatgttcatttttgcttgctgctacagaaggcttcaccgacagaaatcagacccactgctgaacctctatgtttaatttttgattttccagagccatgaaggcacttagcactttagtttttttgtccttgattggcattgtttttagtaatcctattcctagagttagctttattaaaccagttaatgttactgaagggagcaatgtgacactggtaggtgtagagggtgctaaaaacaccacctggacaaaatatcaccttaatgggtggaaagatatctgcaattggagtgtgacagtttatacatgcgagggagttaatcttaccattgtcaatgcaacctcagctcaaaatggtagaattcaagggcaaagtgttagtgattctgaggggtattatacccaacatacttttatctatgacattaaggtcataccattgccaacacccagcccacctagcactactcaaaccactacatcaactcagcccaccgccaccacaacagcagaggcatttttgttgctgccaccatctagcagtcccactgctagtaccaataagcagactactaaatttttgtccactactgaaagccacaccacagctaccttgagagccttctctagcaccgctaatcttacctcgctttcctatacattaatcagttctgttactacctctaccccagcttctcttcccactcccctgaagcaaaccgaaggcggtttgcaatggcagatcaccctactcattgtgatcggggtggtcatcctagcgatgctgctctacttcatcttctgccgccgcatccccaacgcgaaaccggtctacaagcccatcgttatcgggcagccggagccgcttcaggtggagggaggtctaaggaatcttctcttctcttttacagtatggtgatttgaactatgattcctagacagttctttatcattggtcttctctgcgcgctccaagtctgtgccaccctcgctctggtggctaatgcgagtccagactgcattggaccgttcgcctcctacgtgctctttgccttcatcacctgcatctgctgctgtagcatagtctgcctgcttattaccttcttccagttcgttgactgggtctttgtgcgcatcgcctacctgcgccaccacccccagtaccgcgaccaaagagtggcgcagctgctcaggctcatctgataagcatgcgggctttgctacttctcatgcttctactattgctagctcccctggtcgccccctttcccctcaaatcccccacccagtcccccaaagaggttcgaaactgtaaattccaagaaccctggaaattcctcaaatgctaccagctcaaatcagacatgcaccccagctggataattatcatgggaatcgtgaacatccttgcctgcaccttcttttcctttgtgatttacccccgctttgactttggttggaacgcacccgaggcgctctggctcccgcctgatcccgacacaccaccacagcagcagcaaaatcaggcacacgcaccaccaccacagcctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtatccctacgatgcagacaacgcaccgaccgtgcccttcatcaaccctcccttcgtctcttcagatggattccaagaaaagcccctgggggtgttgtcccttaggctggccgaccctgtcaccaccaagaatggggaaattaccctcaagctgggggagggggtggaccttgacgactcgggaaaactcattgcaaacacagtaaacaaggccattgcccctctcagtttttccaacaacaccatttcccttaacatggatacccctttatacaccaaagatggaaaactatccttacaagtttctccaccattaagtatattaaaatcaacaattttgaatacattagctctagcttttggctcaggtttaggactcagtggcagcgccctggcagtacagttagcctctccacttacatttgatgataaagggaatataaagattaccctaaacaggggattgcatgttacaacaggagatgcaattgaaagcaacatcagttgggctaaaggtataaaatttgaagatggtgccatagctacaaacattggtaaggggctagagttcggaaccagtagtacagaaacaggagttaataatgcttatccaatccaagttaaacttggctctggtctcagctttgacagcacaggagccataatggctggcaataaagactatgataaattaactttgtggacaacgcctgacccatcaccaaactgtcaaatacttgcagaaaatgatgcaaaactaacactttgcttaactaagtgtgacagtcaaatactggccactgtatcagttttggttgttagaagtggaaacttaaacccaattactggcacagtaagcagtgctcaagtttttctacgttttgatgcaaatggtgttcttttaacagaacactctacactaaaaaaatactggggctacaagcaaggagatagcatagatggcactccatacaccaatgctgttggttttatgccaaattcaacagcttatccaaagacccaaagttctactactaaaaataatatagtgggtcaagtatacatgaatggagatgtttcaaaacccatgcttcttactataactcttaatggtactgatgacaccaccagtgcatactcaatgtcattttcatacacctggactaacggaagctatatcggagcaacatttggagctaactcatacaccttctcctacatagcccaacaataatcccaccctgcatgccaacccaccttttccctctatttataaatggaaactgaaacaaaaataaagttcaagtgttttattgattcaacagtttttcacaggattcgagtagttattttccctccaccctcccatctcatggaatacactatcctctccccacgcacagccttaaacatctgaatgctattggtaatggacatggttttgatctccacattccacacagtttcagagcgagacagtctcgggtcggtcaaggagatgaaaccctccgggcactcctgcatctgcacctcacagttcaacagctgagggctgtcctcggtgattggaatcacagttatctggaataagagcgatgagaatcataatccgcaaacgggatcgggcggttgtggcgcatcaggccccgcagcagtcgctgtctgcgccgctccgtcaagctgctactcaaggggtccgggtccagggactccctgcgcatgatgccaatggccctgagcatcagtcgcctggtacggcgggcgcagcagcggatgcggatctcactcaggtcggagcagtacgtgcagcacagcaccaccaagttgttcaacagtccatagttcaacgtgctccagccaaaactcatttgtggaactatgctgcccacatgtccatcgtaccagatcctgatgtaaatcaggtggcgtcccctccagaacacactgcccatgtacatgatctccttgggcatgtgcaggttcaccacctcccggtaccacatcacccgctggttgaacatgcagccctggataattctgcggaaccagatggcaagtaccgtcccgcccgccatgcagcgcagggaccccgggttctggcaatggcagtggatcacccaccgctcgcgaccgtggatcaactgggaactaaacaagtctatgttggcacagcacaggcacacgctcatgcatgtcttcagcactctcaattcctcgggggtcaggaccatatcccagggcacagggaactcttgcaggacagtgaacccggccgaacagggcaatcctcgcacggaacttacattgtgcatggacagggtatcgcaatcaggcagcaccggatgatcctccaccagagaagcgcggctctcggtctcctcacagcgaggtaaggtggccggcggttggtacggatgatggcgagataacgctaatcgtgttctggatcgtgtcatgatggagctgtttccggacattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaaacacatcagttaccccgcccctaacgaacgccgctgtcacagccaatcagcgcgccccatccccaaattttcacgccttatttgcatattaactcacacaaaaaaaataaggtatattattgatgatgc

SEQ ID NO: 32 - DNA, 35064 bp, Adenovirus G52
  MISC_FEATURE (1)..(35064): Complete Genome
ctgcaggttaattaaggaagggcgaattctgcagatatccatcacactggcggccgctcgagcatgcatctagagggcccaattcgccctatagtgagtcgtattacaattcactggcccatcatcaataatataccttaaagctggaaacgagccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgcatcatcaataatataccttattctggaaacgtgccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggtccccgagatgtacggtgttttctgcagcgagacggtccggaactcagatgagctgcttaatacagatctgctggatgttcccaactcgcctgtgacttcgcctccgtcgcttcatgatcttttcgatgtggaagtggatccaccgcaagatcccaacgaggacgcggtaaacagtatgttccctgaatgtctgtttgaggcggctgaggagggttctcacagcagtgaagagagcaaacggggagaggaactggacttgaaatgctacgaggaatgtctgccttctagcgattctgaaacggaacaaacagggggagacggctgtactgagccggtagtgaaaaatgaacttgtattagactgtcctgatcaacctggtcatggctgccgtgcctgtgcttttcatagaaatgccagcggaaatcctgaaactctatgtgctctgtgttacctgcgtcttaccagcgattttgtatacagtaagtaggagctttttcgatttgcgcatggtggtgggattgttaaagtgtgttgggcttattgcttgtgtaatgttttacaggtgacgtgtctgacgcggaaggggacggagatagatcagggtctgctaattctccttgcactttgggggctgtggttccagttggcattattaaacccgtggcggtcagagtctcaggcagacggtgtgcagttgaaaaattggaagacttgctacaggaagaacagacggaacctttggacctatccatgaaacgccctaagctgacctaagtgtgtttattgcatgtaataaaagtgttgatctttgaactgtgtttatgtgttgggtgtgtctgtgggtatataagcaggtgaatgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagggtaaaaagagagcaggaggcgcagtttgctaggctgttggccgatactcctggagtttttgtggctctggatctaggccatcactctcttttccaagagaaaatcatcaaaaacttaacttttacgtctcctggtcgcacggttgcttccgctgcctttattacctatattttggatcaatggagcaacagcgacagccacctgtcgtgggagtacatgctggattacatggcgatggctctgtggagggccatgctgcggaggagggtttgcatttacttgcgggcgcagcctccgcggctggaccgagtggtggaggagaacgagccggaggagaccgagaatctgagagccggcctggaccctccagtggaagactaggtgctgaggatgatcctgaagaggggactagtgggggtgctaggaaaaagcaaaaaactgagcctgaacctagaaactttttgaatgagttgactgtaagcctaatgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttacactattcgccgcactgttaatataaaaaagagtgtttatgttattggtcatggagctctggtgcaggtgcagaccccagaccgggtggctttcaattgcggcatgcagagtttgggccccggggtgataggtttgaatggagttacatttcaaaatgtcagatttactggtgataattttaatggctctgtgtttgtgactagcacccagctaaccctccacggtgtttacttttttaactttaacaatacatgtgtggagtcatggggtagggtgtctctgaggggctgcagttttcatggttgctggaaggcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaattgtcacaccttgcgcaccgtgcacatagtgtcccactcgcgccgcacctggccaacatttgagcacaatatgctcatgcgttgtgccgttcacctaggtgctagacgcggcgtgtttatgccttaccaatgtaactttagccatactaagattttgctggaaactgattccttccctcgagtatgttttaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagccacaaagggtataaagtggcatgaggggtgggcgcggtgtttcaaaatgagcgggacgacggacggcaacgcgtttgaggggggagtgttcagtccatatctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaactccgattctacagaatcttaaataaagacaaataaatttgttgaaaataaacggctttatttgttttttttggctcggtaggctcgggtccacctgtcccggtcgttaaggaccttgtgtatgttttccaagacccggtacagatgggcttggatgttcaagtacatgggcatgaggccatcccgggggtggagataggaccattgcagagcgtcatgctccggggtggtgttgtaaataacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcatcttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtggcctcctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactgggggatgatagttccatctgggcctggggcgtagttgccctcacaaatctgcatttcccaggccttaatttccgaggggggtatcatgtccacctggggggcgataaagaacacggtttctggcgggggattgatgagctgggtggaaagcaagttacgcaacagttgggatttgccgcagccggtgggaccgtagatgaccccgatgacgggttgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtctgccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagtgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtccagcttccgtgacaaaaaggctgtcggtgtccccgtagaccgacttgagggggcgatcttccaaaggtgttccgagatcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcaccccccaaaggggtataaaagggggcgtgcccaccctccccgtcactttcttccgcatcgctgtggaccagagccagctgttcgggtgagtaggccctctcaaaagccggcatgatctcggcgctcaagttgtcagtttctacgaaagaggaggatttgatattcacgtgccccgcggcgatgcttttgatggtggaagggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttcagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtgaagatgccgggtagcaaaacctgattaaaataatcgatttgtgtgtccgtgtcttgcaacgcctcgtcccacttcttcaccgcgagggccctttcgtagggattcaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgcggggtttttcggcccggtagaggatctgcctgaagatggcgtgggagttggaagagatggtggggcgttggaagacgttaaagttggccccgggcagtcccacggagtcttggatgaactgggcgtaggattcccggagcttgtccaccagggctgcggttaccagcacgtcgagagcgcagtagtccaacgtctcgcggaccaggttgtaggccgtctcttgttttttctcccacagttcgcgattgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcacggggcatgaagttgcgagagatcctgaagggtccgggtacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcgaaactcgcgaaactttttccccacggccattttctccggcgtcaccacgtagaaagtgcaggggcggtcgttccagacgtcccatcggagctctagggccagctcgcaggcttggcgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgcccttcttctctgggtggacgacggtggggacgacgacgccccgtgtgccgcaagtccagatctccgccacggaggggcgcaggcgctgcaggagggggcgcagctgcccgctgtccagggagtcgagggcggccgcgctgaggtcgacgggaagcgtttgcaagttcactttcagaagaccggtaagagcgtgagccaggtgcaaatggtacttgatttccaggggggtgttggaagaggcgtccacggcgtagaggaggccgtgtccgcgcggggctaccaccgtgccccgaggagactttatctcactcgtcgagggcgagcgccggggggcagaggcggctctgcgccggggggcgatggaggcagaggcacgttttcgtgaggattcggcagcggttgatgacgagcccggagactgctggcgtgggcgacgacgcggcggttgaggtcctggatgtgctgtctctgcgtgaagaccaccggtccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtgacccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttgagttccacgtgacgggcgaagacggcgtagtttctgaggcgctgaaagaggtagttgagcgtggtggcgatgtgctcgcagacgaagaagtacatgatccagcgtcgcagggtcatctcgttgatgtctccgatggcttcgagacgctccatggcctcgtagaagtcgacggcgaagttgaaaaattgggagttgcgggcggctaccgtgagttcttcttgcaggaggcggatgagatcggcgaccgtgtcgcgtacctcctgttcgaaagcgccccgaggcgcctctgcttcttcctccggctcctcctcttccaggggcacaggttcctccgccagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaaaacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccatgacggaccagttcacgacttgcatgccgggttgggtgatctccgtgtacttgaggcgcgagtaggccctggactcgaacacgtagtcgttgcatgtgcgcaccagatactggtagccgaccaggaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcgaacgcggttccagatgttgcgcagggggcgaaagcgttccatggtgggcacgctctgccccgtgaggcgggcgcagtcctgtacgctctagatggaaaaaagacagggcggtcatcgactcccttccgtagctcggggggtaaagtcgcaagggtgcggcggcggggaaccccggttcgaaaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgaccccagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgggagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgaaacgttccgcgacgccatgttgaacatcgcggagcccgagggtcgctggctcttggatctgattaacatcctgcagagcatcgtggtgcaggagaggggcctgagtttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcaattttggcatccctgcaaagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtaccgtcgcgcaccaacccgacgcacgagaaagtcctgactatcgtaaacgccctggtagacagcaaagctatccgccgcgacgaggcggggctgatctacaacgctctgttggaacgggtggcgcgctacaacagcactaacgttcagaccaatctggatcgcctcaccaccgacgtgaaggaggcgctggctcagaaggagcggtttctgagggacagcaatctgggatctctggtggcactcaacgccttcctgagcacgcagccggccaacgtgccccgcgggcaggaggactacgtgagcttcatcagcgctctgaggctgctggtgtccgaggtgccacagagcgaggtgtaccagtctgggccggattacttcttccagacgtcccgacagggcttgcaaacggtgaacctgactcaggcctttaaaaatttgcaaggcatgtggggcgtcaaggccccggtgggcgatcgcgccactatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagccgggccctgggtcaggaagatatcggcagcctggaagccacgttgaactttttgctaaccaaccggaggcaaaaaataccctcccagttcacgttaagcgccgaggaggagaggattctgcgatacgtgcagcagtccgtgagtctgtacttgatgcgggagggcgccaccgcttccacggctttagacatgacggctcggaacatggaaccgtccttttactccgcccaccgaccgttcattaaccgtttgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgatagcattttcacgccggctaatcgccgattccagaagaaggagggcggagacgagctccccctctccagcgtggaagctgcctctaggggagagagcccctttcccagtctgtcttccgccagcagtggtcgtgtcacgcgcccacggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgccagagagaagacccggacgactccgcagacgatagtagcgtgttggacctgggagggagcggagccaacccctttgctcacttgcaacccaaagggcgttcgagtcgcctgtactaataaaaaaagacgcggaaacttaccagagccatggccacagcgtgtgtcctttcttcctctctttcctcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcgcccctgtacgataccaccaaggtgtacctggtggacaacaagtcggcggacatcgcctccctgaattaccaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggctaaaaaccagcctcccgagtacgaatggtttgagttcaccattcccgagggcaactattccgagaccatgactatcgatctgatgaacaatgcgatcgtggacaattacctgcaagtggggaggcagaacggggtgctggagagcgatatcggcgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttagggatcagaaagcgccgccccttccaagagggctttcagatcatgtatgaggacctggaaggaggtaacattccaggtttgctagacgtgccggcgtatgaagagagtgttaaacaggcggaggcgcagggacgagagattcgaggcgacacctttgccacggaacctcacgaactggtaataaaacctctggaacaagacagtaaaaaacggagttacaacattatatccggcactatgaataccttgtaccggagctggtttctggcttacaactacggcgatcccgagaagggagtgagatcatggaccatactcaccaccactgacgtgacctgcggctcgcagcaagtgtactggtccctgccggatatgatgcaagacccggtcaccttccgcccctccacccaggtcagcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctctggccgaacggctgtagacgataccatagatgccgtgattgccgacgcccgccggtacaaccccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcagtggaaagggcgacgggtacaacgcgttttgaggccgggcaccgcggtagtttttaccccgggagaacggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggacagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgtcacgtcagcttcaaccgccgtggaagccatggaaacgcaaaccgaaacccccgccgcggttggtaccaaagaagtggcgttgcaaaccgacccctggtacgaatttgccgccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgacctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggacaccaactttcaagaaaaagtggtcaacggggtggtgaccggcatccacggcgcggtagatctcgccaatcaagcggtgcagaaagagattgataggcgtttggaaaattcgcgggtaccgccgcagaggggggatgaggtggaggtcgaggaagtagaagtagaggaaaagctgcccccgctggagaaagttcccggtgcgcctccaagaccgcagaagcggcccaggccagaactagaagaaactctggtgacggagagcaaggagcctccctcgtacgagcaagccttgaaagagggcgcctctccaccctcctacccgatgactaagccgatcgcacccatggctcgaccggtgtacggcaaggattacaagcccgtcacgctagagctgcccccaccgcccccttcgcgtccgacagtgcctccactgcctgccccgtcggcgggtcccgtgtctgcaccatccgctgtgcctctgccagccgcccgtcccgtggccgtggccactgccaggaaccccagaggccagagaggagccaactggcaaaacacgctgaacagcatcgtgggcctgggggtgaaaagcctgaaacgccgccgttgctattattaaaaagtgtagctaaaaaatttcccgttgtatacgcctcctatgttaccgccagagacgcgtgactgtcgccgcgagcgccgcttccaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctcaccctgcgctttgtgcccgtagaccgggaggacaccgcgtactcttacaaagtgcgctacacgctggccgtaggggacaaccgagtgctggacatggccagcacctacttcgacatccggggggtgctggatcggggtcctagcttcaagccctactccggcaccgcttacaactccctggctcccaagggagctccaaactccgtagagtggccggataatactaaaacaaaagtgagagcccaagcaccgtttgtaagcgacgaaatcactaaagacggcataaaggttggaacagataccgcaaccacccaacaaagcatttacgccgataaaacgtatcaacctgaaccacaagtaggggaaacacagtggaacagcgatgtaggcactaatgataaagtggcaggaagagttttaaagaaaacgaccccaatgtatccttgttatggttcttacgcacgacccacgaacgaaaaaggagggcaggcgaaggctgacacccaagtggatatgcagttttttgccaccactgcagccaatacaacaccaaaagctgttctttatgctgaagatgttaacttagaaggtcccgatacgcacttggtgtttaaacccactgtgacagagggaacgacaagtgccgaagctttgctagcgcaacaagccgctccaaaccgtccaaattacattgcttttagggacaattttattggactaatgtattacaacagcacgggaaacatgggggtgcttgccggtcaggcttcgcagctaaatgcggtagtagatttgcaagatagaaatacggaactatcctaccagctgatgttggatgcactgggagacagaagtcgctacttttctatgtggaatcaagccgtagatagttatgatccagatgttagaattgtggaaaatcacggagtagaggacgaactaccaaactattgtttcccattgggaggaatggcggtcacagacacctactcccccataaaatccaataatggaagcggttggcaagtagacaacgatacgtttgccgacaggggggtggaaataggctcgggaaacatgttcgccatggagatcaatttgcaagccaacctgtggcgcagttttttgtattctaacattgggctatacctcccggactctttaaaattaacccctgacaacatcacactcccagaaaacaaaaacacctaccagtacatgaacgggcgtgtgacaccacccgggcttgtggacacatacgtcaatgtgggagcccgctggtcccccgatgttatggacagcatcaaccccttcaaccaccaccgcaatgctggccttcgctaccgttccatgctcctgggcaacggtcgctacgtaccattccacattcaggtgccccagaaattttttgccattaagaatcttttgctgctccccggttcctacacctacgagtggaacttccgcaaggacgtgaacatgattttgcaaagctcgctgggtaacgacctgcgagttgacggggccagcatacgcttcgacagcatcaacctgtatgctaactttttccccatggcccacaacacagcttccaccctggaagccatgctgcgcaacgacaccaatgaccagtccttcaacgactacctgtgcgcggccaacatgctgtatcccatccccgccaatgccaccagcgtgcccatctccatcccgtctcgcaactgggccgccttcaggggctggagttttacccgcctcaaaaccaaggagaccccctcgctgggctccgggttcgacccctactttgtctactccggctccattccctacctggacggtaccttctacctcaaccatacttttaagaaggtgtccatcatgtttgactcgtcggtcagctggcccggcaacgaccgcctgctaactccaaatgagtttgaaatcaagcgttcggtggacggtgaagggtacaacgtggcccagagcaacatgaccaaggactggttcctaattcagatgctcagccattacaacatcggctaccagggtttctacgtgcccgagaattacaaagaccgcatgtactccttctttagaaacttccaacctatgagccgtcaagtagtagatactgtggcttataaggactactatcaggacgttaagctcccctaccagcacaacaactcagggttcgtgggctacatgggtcccaccatgcgagaggggcaagcgtaccccgccaactacccctatcccctgattggggccaccgccgtacccagcctgacgcagaaaaagttcctctgtgaccgggtgatgtggaggatacccttctctagcaacttcatgtctatgggctccctcaccgacctggggcagaacatgctgtacgccaactccgctcacgccttggacatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggaaaccggggggggtccactggctcgccttcgcctggaacccgcgtaaccgcacctgctacctgttcgacccttttggtttctccgacgaaaggctgaagcagatctaccagttcgagtacgaggggctcctcaagcgcagcgctctggcctccacgcccgaccactgcgtcaccctggaaaagtccacccagacggtccaggggcccttctcggccgcctgcgggctattctgttgcatgtttttgcacgccttcgtgcactggcctcacacccccatggatcacaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgaacgggccacggccttcgaaagcatgagccaaagagtgtaatcaataaaaaccatttttatttgacatgctacgagcttctggcgtttttattaaaaatcgaagggttcgagggaggggtcctcgtgcccactggggagggacacgttgcgatactggaaacgggcgctccaacgaaactcggggatcaccagccgcggcaggggcacgtcttctaggttctgcttccaaaactgccgcaccagctgcagggctcccatgacgtcgggcgccgatatcttgaagtcgcagttagggccggagctcccgcggctgttgcggaacacggggttggcacactggaacaccatcacgctggggttgtgaatactagccagggccgttgggtcggtcacctccgacgcatccagatcctcggcgttgctcagggcgaacggggtcagcttgcacatctgccgcccgatctggggcaccaggtcgggtttgttgaggcaatcgcagcgcagagggatcaggatgcgacgctgcccgcgttgcatgatagggtaactcgctgccaggaactcctccatctgacggaaggccatctgggccttcgtgccctcggtgaaaaagagcccacaggacttgctagagaatacgttattgccgcagttgatgtcttccgagcagcagcgggcgtcttcattcttcagctgaaccacgttgcgaccccagcggttctggaccaccttggctttcgtaggatgctccttcaacgcccgctgaccgttctcgctggtcacatccatttccaccacgtgctccttgcagaccatctccactccgtggaagcagaacaggacgccctcctgccgggtattgcgatgctcccacacggcgcacccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagcccctctgctctcgttgtccacgtggaacttctccatcaacaccgtcatgacttccatgcccttctcccaggcagtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccacggtgccttcgccctcgctgtcggagacaatctccggggatggcggcggcgcaagtgttgccttgcgagccttcttcttgggagggagcggaggcacctcctgctcgcgctcggggctcatctcccgcaagtagggggttatggagctgcctgcttggttctgacggttggccattgtatcctaggcagaaagacatggagcttatgcgcgaggaaactttaaccgccccgtcccccgtcagcgacgaagatgtcatcgtcgaacaggacccgggctacgttacgccgcccgaggatctggaggggcctgaccggcgcgacgctagtgagcggcaggaaaatgagaaagagaaggcacagggctgctaccttctggacggcgacgttttgctaaagcatttcgccaggcagagcaccatagtcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtattcgccgtgcccgaggcgctggccacctatcacatctttttcaaaaaccagcgcatccccctctcgtgccgggccaaccgcaccgcggccgataggaagctcaggcttaaaaacggagccgacatacctgatatcacgtcgctggaggaagtgcccaagattttcgagggtctgggtcgagatgaaaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggagtccctgcactacaccttccgccagggctacgtccgccaggcctgcaagatctccaacgtggagctcagcaacctggtctcctacatgggcatcctccacgagaaccgactggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggattttgcccgccatgagctgcgcgctaccctctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctgctcagcgaaacccaggtcataggtaccttcgagatccagggaccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacttagacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagctgtgggacagccaggcagaggaggtgtcagaggacgaggaggagatggaaagctgggacagcctaggcgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcagcgggtaaggccaaacgcgagcggcgggggtattgctcatggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccaaggatccaccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagttatcagccccagatgggtctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccaaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcacctggacgctacccagacgccttcattcccaactttgacgcagtgagtgaatccgtggacggctacgactgatgacagatggtgcggccgtgagagctcggctgcgacatctgcatcactgccgtcagcctcgctgctacgctcgggagccgatcgtcttcagctactttgagctgccggacgagcaccctcagggaccggctcacgggttgaaactcgagatcgagaacgcgctcgagtctcgcctcatcgacgccttcgccgcccggcctctcctggtagaaaccgaacgcgggaccactaccatcaccctgttctgcatctgccccacgcccggattacatgaagatctgtgttgtcatctttgcgctcagtttaataaaaactgaactttttgccgcaccttcaacgccatctgtgatttctacaacaaaaagttcttctggcaaaggtacacaaactgtattttattctaattctacctcatctatcgtgctgaactgcgcctgcactaacgaacttatccagtggattgcaaacggtagtgtgtgcaagtacttttgggggaacgagatagttagtagaaataacagcctttgcgagcactgcaactcctccacactaatcctttatcccccatttgttactggatggtatatgtgcgttggctccggtttaaatcctagttgctttcataagtggtttctacaaaaagagacccttcccaacaattctgtttctttttccaccctgtcctactgctgttctccctctggttactctttcaaacctctaattggtattttagctttgatactgataatctttattaactttataataattaacaccttacagtaaacatgcttgttatcctcctgctcgccacatttttcgctctctctcacgccagaacaagtattgttggcgcaggttacaatgcaactcttcaatctgcttacatgccagattccgaccagataccccatattacgtggtacttacaaacctccaaacctaattcttcattttatgaaggaaacaaactctgcgatgactccgacaacaggacgcacacatttccccacccttcactacaattcgaatgcgtaaacaaaagcttgaagctttacaacttaaagccttcagattctggcttgtatcatgctgtagttgaaaaaagtaatttagaagtccacagtgattacattgaattgatggttgtggacctgccacctccaaaatgtgaggtttcctcctcttaccttgaagttcaaggcgtggatgcctactgcctcatacacattaactgcagcaactctaaatatccagctagaatttactataatggacaggaaagtaatcttttttattatttaacaacaagcgctggtaacggtaaacagttacctgattattttactgctgttgttgaattttccacctacagagaaacgtatgccaagcggccttacaatttctcatacccgtttaacgacctttgcaatgaaatacaagcgctcgaaactggaactgattttactccaattttcattgctgccattgttgtgagcttaattaccattattgtcagcctagcattttactgcttttgcaagcccaaaaaacctaagtttgaaaaacttaaactaaaacctgtcattcaacaagtgtgattttgttttccagcatggtagctgcatttctacttctcctctgtctacccatcattttcgtctcttcaactttcgccgcagtttcccacctggaaccagagtgcctaccgccttttgacgtgtatttgattctcacctttgtttgttgtatatccatttgcagtatagcctgcttttttataacaatctttcaagccgccgactatctttacgtgcgaattgcttactttagacaccatcctgaatacagaaatcaaaacgttgcctccttactttgtttggcatgattaagctattgctgatacttaattatttacccctaatcaactgtaattgtccattcaccaaaccctggtcattctacacctgttatgataaaatccccgacactcctgttgcttggctttacgcagccaccgccgctttggtatttgtatctacttgccttggagtaaaattgtattttattctacacactgggtggctacatcccagagaagatttacctagatatcctcttgtaaacgcttttcaattacagcctctgcctcctcctgatcttcttcctcgagctccctctattgtgagctactttcaactcaccggtggagatgactgactctcaggacattaatattagtgtggaaagaatagctgctcagcgtcagcgagaaacgcgagtgttggaatacctggaactacagcaacttaaagagtcccactggtgtgagaaaggagtgctgtgccatgttaagcaggcagccctttcttacgatgtcagccttcagggacatgaactgtcttacactttgccttcgcaaaaacaaaccttctgcaccatgatgggctctacctccatcacaatcacccaacaaaccggacctgttgagggagctatcctgtgtcactgtcacgcgcctgattgtatgcccaagctaatcaaaactctctgtgctttaggtgatatatttaaaatgtaagccagtatcaataaacttaccttaaatttgacagcaattttttggtattatcattcagcagcaccactttaccctcttcccaactctcatatgggatatgatggtgggcggcaaacttcctccaaaccctgaaagaaatatcggtatccacttccttgtcctcacccacaattttcatcttttcatagatgaaaagaacccgagttgatgaagacttcaaccccgtctacccttatgacaccacaaccactccagccgttcctttcatatcacccccgtttgtaaacagtgacggtcttcaggaaaacccccccggagttttaagcctgcgaatagctaaacccctgtattttgacatggagagaaaactagccctttcacttggaagagggctaacaattaccgcgaacggacagttagaaagcacccagagcgtgcagactaacccgccgttaactgtcaccaataacaacacacttatcctacgctactcctcccctttaatcctaactgacaataatttaaccgtaggcttctcaagtcctctccgtgttatagacaacaaactgacattcacttttacctcacctctccgttatgaaaacgaaacccttaccttcaattacacagagccccttacacttatgaacagcaaccttgcgcttaacgtaaactcctctaaaggccttagggttgacgggggctcactaggtacaaacctaagtcctgacttaaggtttaacagcagtggagccatagcttttggtatacaaaccctatggacacccccgacctcaaatcctaactgcaccgtttacaccgaaagcgattccttacttagtctctgtttaactaaatgcggagctcacgttttaggaagtgtaagcttaaccggggtagcaggtaccatgacaaacatggctgaaacttcgcttgctattgaatttacgtttgacgacactggaaaactacttcactcaccacttgttaacaacacttttagcattcgtcagggcgacagccccgcctcaaatcctacctacaatgctctagcatttatgccaaacagtaccctctacgctagaggaggaagtggtgaaccccgaaacaattactacgtccaaacatacctcaggggaaatgttcagagaccgattaccctcactgttactttcaactcagccgccacggggtattccttatcttttaagtggactgctgttgtacgtgaaaaatttgcagctcctgcaacttcattttgctacattaccgaacaataaaaccctgtgttcccaccgtttcgttttttccagatgaaacgggccagagttgatgaagacttcaacccagtgtacccttatgaccccccacatgctcccgttatgcccttcattactccaccttttacctcctcggatgggttacaggaaaaaccacttggagtgttaagtttaaactacagagatcccattactacgcaaaatgggtctcttacaattaaactaggaaacggcctcactctagacaaccagggacaactaacatcaaccgctggggaagtagaacctccactcactaacgctaacaacaaacttgcactggtctatagggaacctttagcagtaaagcgcaacagcctaaccttatcgcacaccgctccccttgttattgctgataactctttagcattgcaagtttcagagcctatttttataaatgacaaggacaaactagccctgcagacagccgcgccccttgtaactaacgctggcacccttcgcttacagagcgccgcccctttaggcattgcagaccaaaccctaaaactcctgtttaccaaccctttgtacttgcagaataactttctcacgttagccattgaacgaccccttgccattaccaatactggaaagctggctctacagctctccccaccgctacaaacagcagacacaggcttgactttgcaaaccaacgtgccattaactgtaagcgacgggaccctaggcttagccataaagcgcccacttattgttcaggacaacaacttgtttttggacttcagagctcccctgcgtcttttcaacagcgaccccgtactagggcttaacttttacacccctcttgcagtgcgcgatgaggcgctcactgttaacacaggccgcggcctcacagtgagttacgatggtttaattttaaatcttggtaaggatcttcgcttcgacaacaacaccgtttctgtcgctcttagtgctgctttgcctttacaatacactgatcagcttcgccttaacgtgggcgctgggctgcgttacaatccagtgagtaaaaaattggacgcgaaccccaatcaaaacaagggtttaacctgggaaaatgactacctcattgtaaagctaggaaatggattaggttttgatggcgatggaaacatagctgtttctcctcaagttacatcgcctgacaccttatggaccactgccgatccatcccccaattgttccatctacactgatttagatgccaaaatgtggctctcgttggtaaaacaagggggtatggttcacggttctgttgctttaaaagcattgaaaggaaccctattgagtcctacggaaagtgccattgttattatactacattttgacaattatggagtgcgaattctcaattatcccactttgggcactcaaggcacgttgggaaataatgcaacttggggttataggcagggagaatctgcagacactaatgtactcaatgcactagcatttatgcccagttcaaaaaggtacccaagagggcgtggaagcgaagttcagaatcagactgtgggctacacttgtatacagggtgacctttctatgcccgtaccgtaccaaatacagtacaactatggaccaactggctactcctttaaatttatttggagaactgtttcaagacaaccatttgacatcccatgctgttttttctcttacattacggaagaataaaacaacttttcctttttattttctttttattttacacgcacagtaaggcttcctccgcccttccatttgacagcatacaccagcctctctcccttcatggcagtaaactgctgcgagccagtccggtatttgggagttaagatccaaacagtctctttggtaatcagatgtcgatccgtgatggacacaaatccctggggcaggttctccaacgtttcggtgaaaaactgcatgccgtcctacaaaacaaacaggttcaggctctccacgggttatctccccgatcaaactcagacagggtaaaggtgcgatgatgttccactaaaccacgcaggtggcgctgtctgaacctctcggtgcgactcctgtgaggctggtaagaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcagtcccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctaatggtctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccgacgcacttcctcgtacttgtggtagcagaaccacgtccgccgccaacaggtctccacgtaacgccggtccctgcgtcgctcgcgctctctcctcagtgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagaaacttcccaccatgtactcggttggatctcctgagcacacagcaatacccccctcacattcatatccgccacagaaaaaaaacgtcccagatacccagtgggaatatccaacgacagctgcaaagacagcaaaataatccctctgggagcaagcacaaaatcctccggtgaaaaaagaacatacatattagaataaccctgttgctggggcaaaaaggcccgacgtcccagcaaatgcacatatatatgttgatcagccattgccccgtcttaccgcgtataaagccacgaaaaagtcgagctaaaatccacccaacagcctatagctatatatacactccgcccaatgacgctaacaccgcaccacccacgaccaaagttcacccacacccacaaaacccgcgaaaatccagcgccgtcagcacttccgcaatttcagtctcacaacgtcacttccgcgcgccttttcactttcccacacacgcccttcgcccgccctcgcgccaccccgcgtcaccccgcgtcaccgcacgtcaccccggccccgcctcgctcctccccgctcattatcatattggcacgtttccagaataaggtatattattgatgatggccaagctatttaggtgacactatagaatactcaagctatgcatcaagcttggtaccgagctcggatccactagtaacggccgccagtgtgctggaattcgcccttgtttaaacgcgatcg

SEQ ID NO: 33 - DNA, 500 bp, Adenovirus A12
  MISC_FEATURE (1)..(500): 500bp 5 UTR
ctgcaggttaattaaggaagggcgaattctgcagatatccatcacactggcggccgctcgagcatgcatctagagggcccaattcgccctatagtgagtcgtattacaattcactggcccctatctaataatataccttatactggactagtgccaatattaaaatgaagtgggcgtagtgtgtaatttgattgggtggaggtgtggctttggcgtgcttgtaagtttgggcggatgaggaagtggggcgcggcgtgggagccgggcgcgccggatgtgacgttttagacgccattttacacggaaatgatgttttttgggcgttgtttgtgcaaattttgtgttttaggcgcgaaaactgaaatgcggaagtgaaaattgatgacggcaattttattataggcgcggaatatttaccgagggcagagtgaactctgagcctctacgtgtgggtttcgatacgtgagcgacggggaaactccacgttggcgctcaaaggg

SEQ ID NO: 34 - DNA, 500 bp, Adenovirus A18
  MISC_FEATURE (1)..(500): 500bp 5 UTR
cgatcgcgtttaaacaagggcgaattccagcacactggcggccgttactagtggatccgagctcggtaccaagcttgatgcatagcttgagtattctatagtgtcacctaaatagcttggccctatctaaatatataccttatactggactagagccaatattaaaatgaagtgggtgtggcgatgtactttgattgggtggaggtgtggcctgggcgtgtttgtaagtttgggcggatgaggaagttgggcgcggcgtgggagccgggcgcgccggatgtgacgtgtttaacgccattttaatgcggaaatgatgtgttttgggcgttggttgtgaaaattctgtatttttggcgcgaaaacctgaaatacggaagtgaaaactgatgacgacagtttattataggcgcgtaatatttaccgagggcagagtgaactttgagcctctacgtgtgggtttcggtacgtgagtgttagggaatgtccacgttggcgttcaa

SEQ ID NO: 35 - DNA, 500 bp, Adenovirus A31
  MISC_FEATURE (1)..(500): 500bp 5 UTR
cgatcgcgtttaaacaagggcgaattccagcacactggcggccgttactagtggatccgagctcggtaccaagcttgatgcatagcttgagtattctatagtgtcacctaaatagcttggccatcatcaataatataccttacactggacttgagccaatattaaaatgaagtgggcggagtgaatagttaattgaccgtaggcgtggtttgcaagtttgccgaagccggatgtgacgcgtgtgggagccgggcgcgccggatgtgacgcgttagtcgccatttttataggaaatgacatgttttttgggcgttgttgtgtaagttttgtgtttttggcggtaaaagtgatttgcggaagtgaaaactgtttacgtcagttttattataggcgagtaatatttaccgagggcaaagtgaactttgagccactacgtggtggtttcgatacgtgagcgatagggaaactccacgttggtgtccaaaggacacgtttattgt

SEQ ID NO: 36 - DNA, 500 bp, Adenovirus B3
  MISC_FEATURE (1)..(500): 500bp 5 UTR
tttaaacctatctatataatataccttatagatggaatggtgccaacatgtaaatgaggtaatttaaaaaagtgcgcgctgtgtggtgattggctgcggggttaacggctaaaaggggcggcgcgaccgtgggaaaatgacgtgacttatgtgggaggagttatgttgcaagttattacggtaaatgtgacgtaaaacgaggtgtggtttgaacacggaagtagacagttttcccacgcttactgacaggatatgaggtagttttgggcggatgcaagtgaaaattctccattttcgcgcgaaaactaaatgaggaagtgaatttctgagtcatttcgcggttatgccagggtggagtatttgccgagggccgagtagactttgaccgtttacgtggaggtttcgattaccgtgtttttcacctaaatttccgcgtacggtgtcaaagttctgtgtttttacgtaggtgtcagctgatcgctagggtatttaaacctgac

SEQ ID NO: 37 - DNA, 500 bp, Adenovirus B7
  MISC_FEATURE (1)..(500): 500bp 5 UTR
agaccaaaacgatctcaagcgatcgcgtttaaacaagggcgaattccagcacactggcggccgttactagtggatccgagctcggtaccaagcttgatgcatagcttgagtattctatagtgtcacctaaatagcttggccatcatcaataatataccttatagatggaatggtgccaacatgtaaatgaggtaatttaaaaaagtgcgcgctgtgtggtgattggctgtggggtgaatgactaacatgggcggggcggccgtgggaaaatgacgtgacttatgtgggaggagttatgttgcaagttattgcggtaaatgtgacgtaaaaggaggtgtggtttgaacacggaagtagacagttttcccacgcttactgataggatatgaggtagttttgggcggatgcaagtgaaaattctccattttcgcgcgaaaactgaatgaggaagtgaatttctgagtcatttcgcggttatgacagggtggagtatttgccga

SEQ ID NO: 38 - DNA, 500 bp, Adenovirus B16
  MISC_FEATURE (1)..(500): 500bp 5 UTR
cctgcaggcattatcaataatataccttatagatggaatggtgccaacatgtaaatgaggtaatttaaaaaagtgcgcgctgtgtggtgattggctgcggggtgaacggctaaaaggggcgggcaatgctgggatgtgacgtaacttatgtgggaggagttatgttgcaagttatcgcggtaaaggtgacgtaaaacgaggtgtggtttggacacggaagtagacagttttcccacgtttactgacaggatatgaggtagttttgggcggatgcaagtgaaaattctccattttcgcgcgaaaactgaatgaggaagtgaatttctgagtcatttcgcggttatgacagggtggagtatttgccgagggccgagtagactttgaccgtttacgtggaggtttcgattaccgtgtttttcacctaaatttccgcgtacggtgtcaaagtcctgtgtttttacgtaggtgtcagctgatcactagggtatttaaacctgtcg

SEQ ID NO: 39 - DNA, 500 bp, Adenovirus B21
  MISC_FEATURE (1)..(500): 500bp 5 UTR
ctgcaggttaattaaggaagggcgaattctgcagatatccatcacactggcggccgctcgagcatgcatctagagggcccaattcgccctatagtgagtcgtattacaattcactggcctattatataatataccttatagatggaatggtgccaatatgcaaatgaggtaatttaaaaaagtgcgcgctgtgtggtgattggctgcggggttaacggctaaaaggggcgggcaatgctgggaggtgacgtaacttatgtaggaggagttatgttgcaagttatcgcggtaaaggtgacgtaaaacgaggtgtggtttggacacggaagtagacagttttcccacgcttactgacaggatatgaggtagttttgggcggatgcaagtgaaaattctccattttcgcgcgaaaactgaatgaggaagtgaatttctgagtcatttcgcggttatgacagggtggagtatttgccgagggccgagtagactttgaccgttta

SEQ ID NO: 40 - DNA, 500 bp, Adenovirus B50
  MISC_FEATURE (1)..(500): 500bp 5 UTR
ctgcaggttaattaaggaagggcgaattctgcagatatccatcacactggcggccgctcgagcatgcatctagagggcccaattcgccctatagtgagtcgtattacaattcactggcccaatcaatataatataccttatagatggaatggtgccaatatgtaaatgaggtaatttaaaaaagtgcgcgctgtgtggtgattggctgcggggtgaacggctaaaaggggcggacatgctgggaggtgacgtgacttatgggggaggagttatgttgcaagttatcgcggtaaaggtgacgtaaaacgaggtgtggtttggacacggaagtagacagttttcccacgcttactgacaggatatgaggtagttttgggcggatgcaagtgaaaattctccattttcgcgcgaaaactgaatgaggaagtgaatttctgagtcatttcgcggttatgacagggtggagtatttgccgagggccgagtagactttgaccgttt

SEQ ID NO: 41 - DNA, 500 bp, Adenovirus B11
  MISC_FEATURE (1)..(500): 500bp 5 UTR
cgatcgcgtttaaacaagggcgaattccagcacactggcggccgttactagtggatccgagctcggtaccaagcttgatgcatagcttgagtattctatagtgtcacctaaatagcttggccatcatcaataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccat

SEQ ID NO: 42 - DNA, 500 bp, Adenovirus B14a
  MISC_FEATURE (1)..(500): 500bp 5 UTR
ctgcaggttaattaaggaagggcgaattctgcagatatccatcacactggcggccgctcgagcatgcatctagagggcccaattcgccctatagtgagtcgtattacaattcactggcccatcatcaataatataccttatagatggaatggtgccaatatgtaaatgaggtgattttaaaaagtgtgggctgtgtggtaattggctgtggggttaacggctaaaaggggcggcgcggccgtgggaaaatgacgttttttgggggtggagtgtttttgcaagttgtcgcggtaaatgtgacgcaaacaaaggctttttttttacggaactacttagtgttcccacggtatttaacaggaaatgaggtagttttggccggatgcaagtaaaaattgttcattttcgcgcgaaaactgaatgaggaagtggttttctgaataatgcggtatttatggcagggtggagtatttgttcagggccaggtagactttgacccatta

SEQ ID NO: 43 - DNA, 500 bp, Adenovirus B14b; identical to SEQ ID NO: 42
  MISC_FEATURE (1)..(500): 500bp 5 UTR

SEQ ID NO: 44 - DNA, 500 bp, Adenovirus B34
  MISC_FEATURE (1)..(500): 500bp 5 UTR
aattgctgatttgcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctacggtatttatacctcagggtttgtgtcaagaggccactcttgagtgccagcgagaacatcatcaataatataccttatagatggaatggtgccaatatgtaaatgaggtgattttaaaaattgtggggtgtgtggtgattggctgtggggttaacggctaaacggggcggcgcggccgtgggaaaatgacgttttgtgggggtggagtttttttgcaagttgtcgcgggaaatgtgacgcataaaaaggctttttttctcacggaactactgacttttcccacggtatttaacaggaaa

SEQ ID NO: 45 - DNA, 500 bp, Adenovirus B35
  MISC_FEATURE (1)..(500): 500bp 5 UTR
cgatcgcgtttaaacaagggcgaattccagcacactggcggccgctcgagcatgcatctagagggcccaattcgccctatagtgagtcgtattacaatgcactggcccatcatcaataatataccttatagatggaatggtgccaatatgtaaatgaggtgattttaaaaagtgtgggccgtgtggtgattggctgtggggttaacggttaaaaggggcggcgcggccgtgggaaaatgacgttttatgggggtggagtttttttgcaagttgtcgcgggaaatgttacgcataaaaaggcttcttttctcacggaactacttagttttcccacggtatttaacaggaaatgaggtagttttgaccggatgcaagtgaaaattgctgattttcgcgcgaaaactgaatgaggaagtgtttttctgaataatgtggtatttatggcagggtggagtatttgttcagggccaggtagactttgacccattacgtggaggttt

SEQ ID NO: 46 - DNA, 500 bp, Adenovirus C1
  MISC_FEATURE (1)..(500): 500bp 5 UTR
ttaattaacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggtaaaagtgacgtttttggtgtgcgccggtgtacacgggaagtgacaattttcgcgcggttttaggcggatgttgtagtaaatttgggcgtaaccgagtaagatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaa

SEQ ID NO: 47 - DNA, 500 bp, Adenovirus C2
  MISC_FEATURE (1)..(500): 500bp 5 UTR
tttaaatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgccggatgtggtaaaagtgacgtttttggtgtgcgccggtgtatacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaag

SEQ ID NO: 48 - DNA, 500 bp, Adenovirus C5
  MISC_FEATURE (1)..(500): 500bp 5 UTR
ttaattaacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaa

SEQ ID NO: 49 - DNA, 500 bp, Adenovirus C6
  MISC_FEATURE (1)..(500): 500bp 5 UTR
ttttaaatcatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaa

SEQ ID NO: 50 - DNA, 500 bp, Adenovirus D8
  MISC_FEATURE (1)..(500): 500bp 5 UTR
cgatcgcgtttaaacaagggcgaattccagcacactggcggccgttactagtggatccgagctcggtaccaagcttgatgcatagcttgagtattctatagtgtcacctaaatagcttggcctatctatataatataccccacaaagtaaacaaaagttaatatgcaaatgagcttttaaattttaacggttttagggcagggccaacgttaagtggttaacaagcggtaatgcagttgacgtcaagacatcatcataatataccccacaaagtaaacaaaagttaatatgcaaatgagcttttaaattttaacggttttagggcagggccaacgttaagtggttaacaagcggtaatgcagttgacgtcaagacatcatcataatataccccacaaagtaaacaaaagttaatatgcaaatgagcttttaaattttaacggttttagggcagggccaacgttaagtggttaacaagcggtaatgcagttgacgtcaaga

SEQ ID NO: 51 - DNA, 500 bp, Adenovirus D9
  MISC_FEATURE (1)..(500): 500bp 5 UTR
ctgcaggttaattaaggaagggcgaattctgcagatatccatcacactggcggccgctcgagcatgcatctagagggcccaattcgccctatagtgagtcgtattacaattcactggccccatctatataatataccccacaaagtaaacaaaagttaatatgcaaatgagcttttgaattttaacggtttcggggcggagccaacgctgattggacgagagaagacgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttga

SEQ ID NO: 52 - DNA, 500 bp, Adenovirus D10
  MISC_FEATURE (1)..(500): 500bp 5 UTR
catcatcaataatataccccacaaagtaaacaaaagttaatatgcaaatgaggttttaaatttagggcggggctactgctgattggccgagaaacgttgatgcaaatgacgtcacgacgcacggcgttaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgatccgcagggtatttaaaccagtcgagtccgtcaagag

SEQ ID NO: 53 - DNA, 500 bp, Adenovirus D13
  MISC_FEATURE (1)..(500): 500bp 5 UTR
catcatcaataatataccccacaaagtaaacaaaagttaatatgcaaatgaggttttaaatttagggcggggctactgctgattggccgagaaacgttgatgcaaatgacgtcacgacgcacggctaacggtcgccgcggaggcgtggcctagcccggaagcaagtcgcggggctgatgacgtataaaaaagcggactttagacccggaaacggccgattttcccgcggctacgcccggatatgaggtaattctgggcggatgcaagtgaaattaggtcattttggcgcgaaaactgaatgaggaagtgaaaagtgaaaaataccgggcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggc

SEQ ID NO: 54 - DNA, 500 bp, Adenovirus D17
  MISC_FEATURE (1)..(500): 500bp 5 UTR
catcatcaataatataccccacaaagtaaacaaaagttaatatgcaaatgaggttttaaatttagggcggggctactgctgattggccgagaaacgttgatgcaaatgacgtcacgacgcacggctaacggtcgccgcggaggcgtggcctagcccggaagcaagtcgcggggctgatgacgtataaaaaagcggactttaaacccggaaacggccgattttcccgcggccacgcccggatatgaggtaattctgggcggatgcaagtgaaattaggtcattttggcgcgaaaactgaatgaggaagtgaaaagtgaaaaataccggtcccgcccagggcggaatatttaccgagggccgagagactttgaccgattacgtgtgggtttcgattgcggtgttttttcgcgaatttccgcgtccgtgtcaaagtccggtgtttatgtcacagatcagctgatccacagggtatttaaaccagtcgagcccgtcaagaggcc

SEQ ID NO: 55 - DNA, 500 bp, Adenovirus D20
  MISC_FEATURE (1)..(500): 500bp 5 UTR
catcatcaataatataccccacaaagtaaacaaaagttaatatgtaaatgagcttttgaatttagggcggggccgacgctgattggccgttgcaagaaccgttagtgacgtcacgacgcacggccgacggccgccgcggaggcgtggcctagtccggaagcaagtcgcggggctgatgacgtataaaaaagcggactttagacccggaaacggccgattttcccgcggccacgcccggatatgaggtaattctgggcggatgcaagtgaaattaggccattttggcgcgaaaactgaatgaggaagtgaaaagtgaaaaataccgggcccgcccagggcggaatatttaccgagggccgagagactttgaccgattacgtgggggtttcgattgcggtgttttttcgtgaatttccgcgtccgtgtcaaagtccggtgtttatgtcacagatcagctgatccacagggtatttaaaccagtcgatcccgtcaagaggcca

SEQ ID NO: 56 - DNA, 500 bp, Adenovirus D24
  MISC_FEATURE (1)..(500): 500bp 5 UTR
catcatcaataatataccccacaaagtaaacaaaagttaacatgcaaatgagcttttgaatttagggcggggccagcgctgattggacgagagaagatgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtaaaattaggtcattttggcgcgaaaactgaatgaggaagtgaaaagtgaaaaataccggtcccgcccagggcggaatatttaccgagggccgagagactttgaccgattacgtgggggtttcgattgcggtgttttttcgcgaatttccgcgtccgtgtcaaagtccggtgtttatgtcacagatcagctgatccacagggtatttaaaccagtcgagcccgtcaagaggcc

SEQ ID NO: 57 - DNA, 500 bp, Adenovirus D25
  MISC_FEATURE (1)..(500): 500bp 5 UTR
catcatcaataatataccccacaaagtaaacaaaagttaatatgcaaatgaggttttaaatttagggcggggctactgctgattggccgagaaacgttgatgcaaatgacgtcacgacgcacggctaacggtcgccgcggaggcgtggcctaggccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggc

SEQ ID NO: 58 - DNA, 500 bp, Adenovirus D26
  MISC_FEATURE (1)..(500): 500bp 5 UTR
catcatcaataatataccccacaaagtaaacaaaagttaatatgcaaatgaggttttaaatttagggcggggctactgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgatccgcagggtatttaaaccagtcgagtccgtcaagaggc

SEQ ID NO: 59 - DNA, 500 bp, Adenovirus D27
  MISC_FEATURE (1)..(500): 500bp 5 UTR
catcatcaataatataccccacaaagtaaacaaaagttaatatgcaaatgagcttttgaattttaacggtttcggggcggagccaacgctgattggacgagagaagacgatgcaaatgacgtcacgacgcacggcgttaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgatccgcagggtatttaaaccagtcgagt

SEQ ID NO: 60 - DNA, 500 bp, Adenovirus D33
  MISC_FEATURE (1)..(500): 500bp 5 UTR
catcatcaataatataccccacaaagtaaacaaaagttaatatgcaaatgaggttttaaatttagggcggggctactgctgattggccgagaaacgttgatgcaaatgacgtcacgacgcacggctaacggtcgccgcggaggcgtggcctagcccggaagcaagtcgcgtggctgatgacgtataaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggcc

SEQ ID NO: 61 - DNA, 500 bp, Adenovirus D37
  MISC_FEATURE (1)..(500): 500bp 5 UTR
atcatcaataatataccccacaaagtaaacaaaagttaatatgcaaatgagcttttgaattttaacggttttggggcggagccaacgctgattggacgagaagcggtgatgcaaataacgtcacgacgcacggctaacggccggcgcggaggcgtggcctaggccggaagcaagtcgcggggctaatgacgtataaaaaagcggactttagacccggaaacggccgattttcccgcggccacgcccggatatgaggtaattctgggcggatgcaagtgaaattaggtcattttggcgccaaaactgaatgaggaagtgaaaagtgaaaaatacctgtcccgcccagggcggaatatttaccgagggccgagagactttgaccgattacgtggggtttcgattgcggtgtttttttcgcgaatttccgcgtccgtgtgaaagtccggtgtttatgtcacagatcagctgatccacagggtatttaaaccagttgagcccgt

SEQ ID NO: 62 - DNA, 500 bp, Adenovirus D69; identical to SEQ ID NO: 55
  MISC_FEATURE (1)..(500): 500bp 5 UTR

SEQ ID NO: 63 - DNA, 500 bp, Adenovirus E4
  MISC_FEATURE (1)..(500): 500bp 5 UTR
atcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtaggtgtcagctgatcgtcagggtatttaaacctgcgctctgcagt

SEQ ID NO: 64 - DNA, 500 bp, Adenovirus G52
  MISC_FEATURE (1)..(500): 500bp 5 UTR
ctgcaggttaattaaggaagggcgaattctgcagatatccatcacactggcggccgctcgagcatgcatctagagggcccaattcgccctatagtgagtcgtattacaattcactggcccatcatcaataatataccttaaagctggaaacgagccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcct

SEQ ID NO: 65 - DNA, 150 bp, Adenovirus A12
  MISC_FEATURE (1)..(150): 150bp 5 UTR
ctgcaggttaattaaggaagggcgaattctgcagatatccatcacactggcggccgctcgagcatgcatctagagggcccaattcgccctatagtgagtcgtattacaattcactggcccctatctaataatataccttatactggacta

SEQ ID NO: 66 - DNA, 150 bp, Adenovirus A18
  MISC_FEATURE (1)..(150): 150bp 5 UTR
cgatcgcgtttaaacaagggcgaattccagcacactggcggccgttactagtggatccgagctcggtaccaagcttgatgcatagcttgagtattctatagtgtcacctaaatagcttggccctatctaaatatataccttatactggac

SEQ ID NO: 67 - DNA, 150 bp, Adenovirus A31
  MISC_FEATURE (1)..(150): 150bp 5 UTR
cgatcgcgtttaaacaagggcgaattccagcacactggcggccgttactagtggatccgagctcggtaccaagcttgatgcatagcttgagtattctatagtgtcacctaaatagcttggccatcatcaataatataccttacactggac

SEQ ID NO: 68 - DNA, 150 bp, Adenovirus B3
  MISC_FEATURE (1)..(150): 150bp 5 UTR
tttaaacctatctatataatataccttatagatggaatggtgccaacatgtaaatgaggtaatttaaaaaagtgcgcgctgtgtggtgattggctgcggggttaacggctaaaaggggcggcgcgaccgtgggaaaatgacgtgacttat

SEQ ID NO: 69 - DNA, 150 bp, Adenovirus B7
  MISC_FEATURE (1)..(150): 150bp 5 UTR
agaccaaaacgatctcaagcgatcgcgtttaaacaagggcgaattccagcacactggcggccgttactagtggatccgagctcggtaccaagcttgatgcatagcttgagtattctatagtgtcacctaaatagcttggccatcatcaat

SEQ ID NO: 70 - DNA, 150 bp, Adenovirus B16
  MISC_FEATURE (1)..(150): 150bp 5 UTR
cctgcaggcattatcaataatataccttatagatggaatggtgccaacatgtaaatgaggtaatttaaaaaagtgcgcgctgtgtggtgattggctgcggggtgaacggctaaaaggggcgggcaatgctgggatgtgacgtaacttatg

SEQ ID NO: 71 - DNA, 150 bp, Adenovirus B21
  MISC_FEATURE (1)..(150): 150bp 5 UTR
ctgcaggttaattaaggaagggcgaattctgcagatatccatcacactggcggccgctcgagcatgcatctagagggcccaattcgccctatagtgagtcgtattacaattcactggcctattatataatataccttatagatggaatgg

SEQ ID NO: 72 - DNA, 150 bp, Adenovirus B50
  MISC_FEATURE (1)..(150): 150bp 5 UTR
ctgcaggttaattaaggaagggcgaattctgcagatatccatcacactggcggccgctcgagcatgcatctagagggcccaattcgccctatagtgagtcgtattacaattcactggcccaatcaatataatataccttatagatggaat

SEQ ID NO: 73 - DNA, 150 bp, Adenovirus B11
  MISC_FEATURE (1)..(150): 150bp 5 UTR
cgatcgcgtttaaacaagggcgaattccagcacactggcggccgttactagtggatccgagctcggtaccaagcttgatgcatagcttgagtattctatagtgtcacctaaatagcttggccatcatcaataatataccttatagatgga

SEQ ID NO: 74 - DNA, 150 bp, Adenovirus B14a
  MISC_FEATURE (1)..(150): 150bp 5 UTR
ctgcaggttaattaaggaagggcgaattctgcagatatccatcacactggcggccgctcgagcatgcatctagagggcccaattcgccctatagtgagtcgtattacaattcactggcccatcatcaataatataccttatagatggaat

SEQ ID NO: 75 - DNA, 150 bp, Adenovirus B14b; identical to SEQ ID NO: 74
  MISC_FEATURE (1)..(150): 150bp 5 UTR

SEQ ID NO: 76 - DNA, 150 bp, Adenovirus B34
  MISC_FEATURE (1)..(150): 150bp 5 UTR
aattgctgatttgcgcgcgaaaactgaatgaggaagtgtttttctgaataatgtggtatttatggcagggtggagtatttgttcagggccaggtagactttgacccattacgtggaggtttcgattaccgtgttttttacctgaatttcc

SEQ ID NO: 77 - DNA, 150 bp, Adenovirus B35
  MISC_FEATURE (1)..(150): 150bp 5 UTR
cgatcgcgtttaaacaagggcgaattccagcacactggcggccgctcgagcatgcatctagagggcccaattcgccctatagtgagtcgtattacaatgcactggcccatcatcaataatataccttatagatggaatggtgccaatatg

SEQ ID NO: 78 - DNA, 150 bp, Adenovirus C1
  MISC_FEATURE (1)..(150): 150bp 5 UTR
ttaattaacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaac

SEQ ID NO: 79 - DNA, 150 bp, Adenovirus C2
  MISC_FEATURE (1)..(150): 150bp 5 UTR
tttaaatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaaca

SEQ ID NO: 80 - DNA, 150 bp, Adenovirus C5; identical to SEQ ID NO: 78
  MISC_FEATURE (1)..(150): 150bp 5 UTR

SEQ ID NO: 81 - DNA, 150 bp, Adenovirus C6
  MISC_FEATURE (1)..(150): 150bp 5 UTR
ttttaaatcatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaac

SEQ ID NO: 82 - DNA, 150 bp, Adenovirus D8
  MISC_FEATURE (1)..(150): 150bp 5 UTR
cgatcgcgtttaaacaagggcgaattccagcacactggcggccgttactagtggatccgagctcggtaccaagcttgatgcatagcttgagtattctatagtgtcacctaaatagcttggcctatctatataatataccccacaaagtaa

SEQ ID NO: 83 - DNA, 150 bp, Adenovirus D9
  MISC_FEATURE (1)..(150): 150bp 5 UTR
ctgcaggttaattaaggaagggcgaattctgcagatatccatcacactggcggccgctcgagcatgcatctagagggcccaattcgccctatagtgagtcgtattacaattcactggccccatctatataatataccccacaaagtaaac

SEQ ID NO: 84 - DNA, 150 bp, Adenovirus D10
  MISC_FEATURE (1)..(150): 150bp 5 UTR
catcatcaataatataccccacaaagtaaacaaaagttaatatgcaaatgaggttttaaatttagggcggggctactgctgattggccgagaaacgttgatgcaaatgacgtcacgacgcacggcgttaacggtcgccgcggaggcgtgg

SEQ ID NO: 85 - DNA, 150 bp, Adenovirus D13
  MISC_FEATURE (1)..(150): 150bp 5 UTR
catcatcaataatataccccacaaagtaaacaaaagttaatatgcaaatgaggttttaaatttagggcggggctactgctgattggccgagaaacgttgatgcaaatgacgtcacgacgcacggctaacggtcgccgcggaggcgtggcc

SEQ ID NO: 86 - DNA, 150 bp, Adenovirus D17; identical to SEQ ID NO: 85
  MISC_FEATURE (1)..(150): 150bp 5 UTR

SEQ ID NO: 87 - DNA, 150 bp, Adenovirus D20
  MISC_FEATURE (1)..(150): 150bp 5 UTR
catcatcaataatataccccacaaagtaaacaaaagttaatatgtaaatgagcttttgaatttagggcggggccgacgctgattggccgttgcaagaaccgttagtgacgtcacgacgcacggccgacggccgccgcggaggcgtggcct

SEQ ID NO: 88 - DNA, 150 bp, Adenovirus D24
  MISC_FEATURE (1)..(150): 150bp 5 UTR
catcatcaataatataccccacaaagtaaacaaaagttaacatgcaaatgagcttttgaatttagggcggggccagcgctgattggacgagagaagatgatgcaaatgacgtcacgacgcacggctaacggtcgccgcggaggcgtggcc

SEQ ID NO: 89 - DNA, 150 bp, Adenovirus D25; identical to SEQ ID NO: 85
  MISC_FEATURE (1)..(150): 150bp 5 UTR

SEQ ID NO: 90 - DNA, 150 bp, Adenovirus D26
  MISC_FEATURE (1)..(150): 150bp 5 UTR
catcatcaataatataccccacaaagtaaacaaaagttaatatgcaaatgaggttttaaatttagggcggggctactgctgattggacgagaaacggtgatgcaaatgacgtcacgacgcacggctaacggtcgccgcggaggcgtggcc

SEQ ID NO: 91 - DNA, 150 bp, Adenovirus D27
  MISC_FEATURE (1)..(150): 150bp 5 UTR
catcatcaataatataccccacaaagtaaacaaaagttaatatgcaaatgagcttttgaattttaacggtttcggggcggagccaacgctgattggacgagagaagacgatgcaaatgacgtcacgacgcacggcgttaacggtcgccgc

SEQ ID NO: 92 - DNA, 150 bp, Adenovirus D33; identical to SEQ ID NO: 85
  MISC_FEATURE (1)..(150): 150bp 5 UTR

SEQ ID NO: 93 - DNA, 150 bp, Adenovirus D37
  MISC_FEATURE (1)..(150): 150bp 5 UTR
atcatcaataatataccccacaaagtaaacaaaagttaatatgcaaatgagcttttgaattttaacggttttggggcggagccaacgctgattggacgagaagcggtgatgcaaataacgtcacgacgcacggctaacggccggcgcgga

SEQ ID NO: 94 - DNA, 150 bp, Adenovirus D69; identical to SEQ ID NO: 87
  MISC_FEATURE (1)..(150): 150bp 5 UTR

SEQ ID NO: 95 - DNA, 150 bp, Adenovirus E4
  MISC_FEATURE (1)..(150): 150bp 5 UTR
atcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggagga

SEQ ID NO: 96 - DNA, 150 bp, Adenovirus G52
  MISC_FEATURE (1)..(150): 150bp 5 UTR
ctgcaggttaattaaggaagggcgaattctgcagatatccatcacactggcggccgctcgagcatgcatctagagggcccaattcgccctatagtgagtcgtattacaattcactggcccatcatcaataatataccttaaagctggaaa

SEQ ID NO: 97 - DNA, 150 bp, Adenovirus A12
  MISC_FEATURE (1)..(150): 150bp 3 ITR
gtccagtataaggtatattattagatagggccaagctatttaggtgacactatagaatactcaagctatgcatcaagcttggtaccgagctcggatccactagtaacggccgccagtgtgctggaattcgcccttgtttaaacgcgatcg

SEQ ID NO: 98 - DNA, 150 bp, Adenovirus A18
  MISC_FEATURE (1)..(150): 150bp 3 ITR
tagtccagtataaggtatatatttagataggggccagtgaattgtaatacgactcactatagggcgaattgggccctctagatgcatgctcgagcggccgccagtgtgatggatatctgcagaattcgcccttccttaattaacctgcag

SEQ ID NO: 99 - DNA, 150 bp, Adenovirus A31
  MISC_FEATURE (1)..(150): 150bp 3 ITR
aagtccagtgtaaggtatattattgatgatgggccagtgaattgtaatacgactcactatagggcgaattgggccctctagatgcatgctcgagcggccgccagtgtgatggatatctgcagaattcgcccttccttaattaacctgcag

SEQ ID NO: 100 - DNA, 150 bp, Adenovirus B3
  MISC_FEATURE (1)..(150): 150bp 3 ITR
acttgcaacgtcattttcccacggtcgcgccgccccttttagccgttaaccccgcagccaatcaccacacagcgcgcacttttttaaattacctcatttacatgttggcaccattccatctataaggtatattatatagatagcctgcag

SEQ ID NO: 101 - DNA, 150 bp, Adenovirus B7
  MISC_FEATURE (1)..(150): 150bp 3 ITR
attccatctataaggtatattattgatgatgggccagtgaattgtaatacgactcactatagggcgaattgggccctctagatgcatgctcgagcggccgccagtgtgatggatatctgcagaattcgcccttccttaattaacctgcag

SEQ ID NO: 102 - DNA, 150 bp, Adenovirus B16
  MISC_FEATURE (1)..(150): 150bp 3 ITR
cttgcaacgtcattttcccacggccgcaccgccccttttagccgttcaccccgcagccaatcaccacacagcgcgcacttttttaaattacctcatttacatgttggcaccattccatctataaggtatattatagataatggcgatcgc

SEQ ID NO: 103 - DNA, 150 bp, Adenovirus B21
  MISC_FEATURE (1)..(150): 150bp 3 ITR
aaccccgcagccaatcaccacacagcgcgcacttttttaaattacctcatttgcatattggcaccattccatctataaggtatattatataatagccaagctatttaggtgacactatagaatactcaagctatgcactgagagatcccc

SEQ ID NO: 104 - DNA, 150 bp, Adenovirus B50
  MISC_FEATURE (1)..(150): 150bp 3 ITR
tccatcgataaggtatatcatattgattggccaagctatttaggtgacactatagaatactcaagctatgcatcaagcttggtaccgagctcggatccactagtaacggccgccagtgtgctggaattcgcccttgtttaaacgcgatcg

SEQ ID NO: 105 - DNA, 150 bp, Adenovirus B11; identical to SEQ ID NO: 101
  MISC_FEATURE (1)..(150): 150bp 3 ITR

SEQ ID NO: 106 - DNA, 150 bp, Adenovirus B14a
  MISC_FEATURE (1)..(150): 150bp 3 ITR
tccatctataaggtatattattgatgatggccaagctatttaggtgacactatagaatactcaagctatgcatcaagcttggtaccgagctcggatccactagtaacggccgccagtgtgctggaattcgcccttgtttaaacgcgatcg

SEQ ID NO: 107 - DNA, 150 bp, Adenovirus B14b
  MISC_FEATURE (1)..(150): 150bp 3 ITR
gtaatgggtcaaagtctacctggccctgaacaaatactccaccctgccataaataccgcattattcagaaaaccacttcctcattcagttttcgcgcgaaaatgaacaatttttacttgcatccggccaaaactacctcatttcctgtta

SEQ ID NO: 108 - DNA, 150 bp, Adenovirus B34; identical to SEQ ID NO: 106
  MISC_FEATURE (1)..(150): 150bp 3' ITR

SEQ ID NO: 109 - DNA, 150 bp, Adenovirus B35; identical to SEQ ID NO: 101
  MISC_FEATURE (1)..(150): 150bp 3' ITR

SEQ ID NO: 110 - DNA, 150 bp, Adenovirus C1
  MISC_FEATURE (1)..(150): 150bp 3' ITR
ctacaattcccaatacatgcaagttactccgccctaaaacctacgtcacccgccccgttcccacgccccgcgccacgtcacaaactccaccccctcattatcatattggcttcaatccaaaataaggtatattattgatgatgatttaaa

SEQ ID NO: 111 - DNA, 150 bp, Adenovirus C2
  MISC_FEATURE (1)..(150): 150bp 3' ITR
tacaattcccaatacatgcaagttactccgccctaaaacctacgtcacccgccccgttcccacgccccgcgccacgtcacaaactccaccccctcattatcatattggcttcaatccaaaataaggtatattattgatgatgttaattaa

SEQ ID NO: 112 - DNA, 150 bp, Adenovirus C5
  MISC_FEATURE (1)..(150): 150bp 3' ITR
ctacaattcccaacacatacaagttactccgccctaaaacctacgtcacccgccccgttcccacgccccgcgccacgtcacaaactccaccccctcattatcatattggcttcaatccaaaataaggtatattattgatgatgatttaaa

SEQ ID NO: 113 - DNA, 150 bp, Adenovirus C6; identical to SEQ ID NO: 111
  MISC_FEATURE (1)..(150): 150bp 3' ITR

SEQ ID NO: 114 - DNA, 150 bp, Adenovirus D8
  MISC_FEATURE (1)..(150): 150bp 3' ITR
ttgtttactttgtggggtggatttataggtgggccagtgaattgtaatacgactcactatagggcgaattgggccctctagatgcatgctcgagcggccgccagtgtgatggatatctgcagaattcgcccttccttaattaacctgcag

SEQ ID NO: 115 - DNA, 150 bp, Adenovirus D9
  MISC_FEATURE (1)..(150): 150bp 3' ITR
ttactttgtggggtatattatatagataggccaagctatttaggtgacactatagaatactcaagctatgcatcaagcttggtaccgagctcggatccactagtaacggccgccagtgtgctggaattcgcccttgtttaaacgcgatcg

SEQ ID NO: 116 - DNA, 150 bp, Adenovirus D10
  MISC_FEATURE (1)..(150): 150bp 3' ITR
ccacgcctccgcggcgaccgttaacgccgtgcgtcgtgacgtcatttgcatcaacgtttctcggccaatcagcagtagccccgccctaaatttaaaacctcatttgcatattaacttttgtttactttgtggggtatattattgatgatg

SEQ ID NO: 117 - DNA, 150 bp, Adenovirus D13
  MISC_FEATURE (1)..(150): 150bp 3' ITR
ccgcgacgaccgtcggccgtgcgtcgtgacgtcatttgcatcaccgcttctcgttcaatgagcgttggctccgcccaaaaaccgttaagattcaaaagctcatttgcatattaacttttgtttactttgtggggtatattattgatgatg

SEQ ID NO: 118 - DNA, 150 bp, Adenovirus D17
  MISC_FEATURE (1)..(150): 150bp 3' ITR
ggccacgcctccgcggcgaccgttagccgtgcgtcgtgacgtcatttgcatcaacgtttctcggccaatcagcagtagccccgccctaaatttaaaacctcatttgcatattaacttttgtttactttgtggggtatattattgatgatg

SEQ ID NO: 119 - DNA, 150 bp, Adenovirus D20
  MISC_FEATURE (1)..(150): 150bp 3' ITR
cagccacgcctccgcggcggccgtcggccgtgcgtcgtgacgtcactaacggttcttgcaacggccaatcagcgtcggccccgccctaaattcaaaagctcatttacatattaacttttgtttactttgtggggtatattattgatgatg

SEQ ID NO: 120 - DNA, 150 bp, Adenovirus D24; identical to SEQ ID NO: 118
  MISC_FEATURE (1)..(150): 150bp 3' ITR

SEQ ID NO: 121 - DNA, 150 bp, Adenovirus D25
  MISC_FEATURE (1)..(150): 150bp 3' ITR
ggccacgcctccgcggcgaccgttagccgtgcgtcgtgacgtcatttgcatcaccgtttctcgaccaatcagcgacgaccccaccctaaattcaaaagctcatttgcatattaacttttgtttactttgtggggtatattattgatgatg

SEQ ID NO: 122 - DNA, 150 bp, Adenovirus D26; identical to SEQ ID NO: 118
  MISC_FEATURE (1)..(150): 150bp 3' ITR

SEQ ID NO: 123 - DNA, 150 bp, Adenovirus D27; identical to SEQ ID NO: 118
  MISC_FEATURE (1)..(150): 150bp 3' ITR

SEQ ID NO: 124 - DNA, 150 bp, Adenovirus D33
  MISC_FEATURE (1)..(150): 150bp 3' ITR
ccgcggcgaccgtcagccgtgcgtcgtgacgtcatttgcatcaccgcttctcggccaatcagcattggctccgccccaaaaccgttaaaattcaaaagctcatttgcatattaacttttgtttactttgtggggtatattattgatgatg

SEQ ID NO: 125 - DNA, 150 bp, Adenovirus D37
  MISC_FEATURE (1)..(150): 150bp 3' ITR
cgcgccggccgttagccgtgcgtcgtgacgttatttgcatcaccgcttctcgtccaatcagcgttggctccgccccaaaaccgttaaaattcaaaagctcatttgcatattaacttttgtttactttgtggggtatattattgatgatgc

SEQ ID NO: 126 - DNA, 150 bp, Adenovirus D69
  MISC_FEATURE (1)..(150): 150bp 3' ITR
agccacgcctccgcggcgaccgttagccgtgcgtcgtgacgtcatttgcatcaacgtttctcggccaatcagcagtagccccgccctaaatttaaaacctcatttgcatattaacttttgtttactttgtggggtatattattgatgatg

SEQ ID NO: 127 - DNA, 150 bp, Adenovirus E4
  MISC_FEATURE (1)..(150): 150bp 3' ITR
tcaaattccgtcgaccgttaaacacatcagttaccccgcccctaacgaacgccgctgtcacagccaatcagcgcgccccatccccaaattttcacgccttatttgcatattaactcacacaaaaaaaataaggtatattattgatgatgc

SEQ ID NO: 128 - DNA, 150 bp, Adenovirus G52
  MISC_FEATURE (1)..(150): 150bp 3' ITR
ttccagaataaggtatattattgatgatggccaagctatttaggtgacactatagaatactcaagctatgcatcaagcttggtaccgagctcggatccactagtaacggccgccagtgtgctggaattcgcccttgtttaaacgcgatcg

SEQ ID NO: 129 - DNA, 1764 bp, Adenovirus A12
  MISC_FEATURE (1)..(1764): Fiber Gene
atgaagcgcagcagaacccagtatgctgaagaaacagaagaaaatgatgacttcaaccccgtttacccttttgacccatttgacacatcagacgtaccctttgttacacccccttttacttcttccaatggtcttcaagaaaaaccaccaggtgtattagcacttaattacaaagaccccattgtaactgaaaatggaacccttacactcaagctaggggacggaataaaacttaatgcccaaggtcaacttacagctagtaataatatcaatgttttggagccccttaccaacacctcacaaggtcttaaactttcttggagcgcccccctagcagtaaaggctagtgccctcacacttaacacaagagcgcccttaaccacaacggatgaaagcttagccttaataaccgcccctcccattacagtagagtcttcgcgtttgggcttggccaccatagcccctctaagcttagatggaggtggaaacctaggtttaaatctttctgctcccctggacgttagtaacaacaatttgcatctcaccactgaaactcccttagttgtaaattctagcggtgccctatctgttgctactgcagaccccataagtgttcgcaacaacgctcttaccctacctacggcagatccgttaatggtgagctccgatgggttgggaataagtgtcactagtcccattacagtaataaacggttccttagccttgtctacaactgctcccctcaacagcacaggatccactttaagtctgtctgttgccaatcctctgactatttcacaagacacattgactgtttccactggtaacggtcttcaagtgtcggggtctcaattagtaacaagaataggggatggtttaacattcgataatggggtcatgaaagtaaacgttgccgggggaatgagaacttctggcggtagaataattttagatgttaattatccctttgatgcgagcaataacctgtccttaagacggggattgggactaatttataaccaatctacaaactggaacttaacaactgatattagtaccgaaaaaggtttaatgtttagtggcaatcaaatagctcttaatgcaggtcaggggcttacatttaataatggccaacttagggttaagttgggagctggacttatttttgattcaaacaataacattgccttaggcagcagcagcaacactccatacgaccctctgacactgtggacaactcctgacccaccaccaaactgcagcctcatacaagagctagatgcaaaactcaccctgtgcttaacaaaaaacggatctattgttaatggcattgtaagtttagtgggtgttaagggtaatctcctaaatatccaaagtactactaccactgtaggagtgcatttagtgtttgatgaacagggaagattaatcacatcaacccctactgccctggttccccaagcttcgtggggatatagacaaggccaatcagtgtctaccaatactgttaccaatggtctaggttttatgcctaatgtgagtgcttaccctagaccaaatgccagtgaggctaaaagccaaatggtaagtctcacgtacttacagggagatacatctaaacctataacaatgaaagttgcatttaatggcattacgtcgctaaatggatactctttaacattcatgtggtcaggtctatcaaactatataaatcagcctttctctacaccatcctgctccttttcttacattacccaagaataa

SEQ ID NO: 130 - DNA, 1761 bp, Adenovirus A18
  MISC_FEATURE (1)..(1761): Fiber Gene
atgaagcgcagcagagtccagtatgctgaagaaactgaagaaaatgatgacttcaaccccgtttacccttttaacccctctgatacaacaattgtgccatttattacgcccccttttaccacttccaatggccttcaagaaaaaccaccaggagtactagcgttgagctacaaagatcccattgttaccgaaaatggaacccttacacttaaattaggggatggaataaaacttaatgcacagggtcaacttacagctagtaacactgctaaggtactagagccccttaccaacaccacacaaggcattaaactttcttggagcgcccccctcgcagtacgggcaagtgcccttacattaattacaaaagcgcctttggttacagcggatgaaagcttaagcttagtaacaacgcctcccattacagtagagtcttctcgtctgggattggctaccatagcccctcttagtttagatggaggtggaaatttaggtttggatttatctgctcccctggacgttagtaacaacaatttgcatctcaccactgaagcccccttagttataaactctggcggtgccctaactgttgctactacggaaccccttggtgttcgtaacaacactctcaccttatctactatggaacccttaacagtaagcgctaatgggttaggaataaacgttaccagtccaatttcggtggccaatggttccttagccttggccgccgctgctcctcttaacaccacaggatccaccttaggtctttctgttacaaatcctctcactatttcaggaaatgcgctcactgtagccactggcaatggtcttcaagtatcggggtctcaattagtagcaagaataggtgatggtttaaggtttgataatggaattataaaggtatatgccgccgggggaatgagaacttcagatggtaaaataattctagatgtcgactacccatttaatgcaaccaccaacttgtctttaagaagaggtttggggctaatttataatcagtctacaaattggaacttaacaactgatattaacactcaaaagggtttaatgttcattggaaatcagatagctattaatgccggacagggacttacatttaataatcaacaactacaggtaaaattgggagctggacttacttttgactcaaacaataacattgtcctagacaatagcagcggcactgcctacgaccctcttacactgtggacaactcccgaccctcttccaaattgcagtcttcttgaagacttagatacaaagctaacattgtgtttaagtaaaaatggcgccattgtacatggcgtggtaagctttgtgcccgttaaaggtgcgctactaaatttacaaaaccctaccagcattggacttcacattctatttgaccaacatggtgtcttacaaacaggaacaccatcagccatagccccacaggcgtactggggatatagacagggacaatccatatcccctactcctgttaccaacgctctgaaatttatgcctaactccagtgcataccccagagctaacggaagtgaaccaaaaagtcaaacgtttacttctacatatatgcaaggcgacatcgctaaacccatgacaatgaaagtctcgtttaatgccgcttctactgttactggctactctttaagctttacatggacaggtatctcaaactaccgtaatcaagctttttcatgcccatcatgttcattttcttacctagcccaagaataa

SEQ ID NO: 131 - DNA, 1668 bp, Adenovirus A31
  MISC_FEATURE (1)..(1668): Fiber Gene
atgaagcgcagcagaacccagtacgctgaagaacctgaagaaaatgacgacttcaaccccgtttacccttttgacccatatgacacagcgcatgtgccctttgttacacccccttttacttcttccaatgcttttcaagaaaaaccacccggtgtattatcacttaattacaaagatcccattgttactgaaaatggatcccttaccctaaagttagggaacggaataaagcttaattcacaaggtcaacttacaaccactaacactaaagtactagaaccccttgcccacacctcacagggtcttacactttcttggagcgccccattatcagttaaggccagtgcccttacacttaatacaatggcaccattcacaacaacaaacgaaagcttaagcttggtcactgcccctcccattacagtggaagcttcacaattgggcttagccactgtagcacctctaagcttagacggagggggaaaccttggtttggatcttctcgctcccttagttgtaaattctagcaacgcgctaaccctatctgcttcagatccgttaactgtaaattccaatagtttaggattaaatattaccagtcccattacactaataaacggatccttggctttagccacatcccctcctctggacaccacaggatctactttaaatctttctgttgctgctcctctcagtgtttcacagaacgcactcactgtttcaaccggtaacggtcttcaagtatcaggatctcaattagtaacaagaataggagatggtttacgatttgataatggggttataaaagcatatgttgccgggggaatgagactctcagggggtaaaataattttagatgttaattatccctttgatgcaaccaccaacctttcattgaggagaggatcgggcctcatatataatgagtctacaaactggaacttaacaactgatatcagcaccgaaaaaggcctaacgtttagtgggaaccaaatagctatcaacgcaggtccaggtctcacgtttaataaccgcaagcttcaggtaaaattgggcgcgggactcactttcgattcaaatgataatattgccttaaatagtattgctactccgtatgatcctttaacgttgtggacaactccggatcctccgcccaactgcactctcagacaagaacttgatgcaaaactaactttgtgtttaacaaagaacgaatctattgtgaatggcatagttagtttgataggtgttaagggggatctcttacatattcaacctaccaccaccactgtgggactgcatttagtgtttgatcgacagggacgattagtcacaacaacgcccactgccttagttccccaggcttcctggggatataaacaaggtcaatcggtatctagcagcgctgttgctaatgctttaggattcatgcctaatgtaagtgcttaccctagaccaaacgcgggtgaagccaaaagtcaaatgttaagtcagacatatttacagggagatacaactaaacctattacaatgaaagttgtatttaatggcaatgcaacagtggatggatactctctaacatttatctggacaggtgtgtcaaactatctaaaccaacagttttcaacaccatcttgttcattttcgtatattgcccaagaataa

SEQ ID NO: 132 - DNA, 960 bp, Adenovirus B3
  MISC_FEATURE (1)..(960): Fiber Gene
atggccaagcgagctcggctaagcacttccttcaacccggtgtacccttatgaagatgaaagcagctcacaacacccatttataaatcctggtttcatttcccctgacgggttcacacaaagtccaaacggggttttaagtcttaaatgtgttaatccacttaccactgcaagcggctccctccaacttaaagtgggaagtggtcttacagtagacactactgatggatccttagaagaaaacatcaaagttaacacccccctaacaaagtcaaaccattctataaatttaccaataggaaacggtttgcaaatagaacaaaacaaactttgcagtaaactcggaaatggtcttacatttgactcttccaattctattgcactgaaaaataacactttatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactga

SEQ ID NO: 133 - DNA, 978 bp, Adenovirus B7
  MISC_FEATURE (1)..(978): Fiber Gene
atgaccaagagagtccggctcagtgattccttcaaccctgtctacccctatgaagatgaaagcacctcccaacacccctttataaacccagggtttatttccccaaatggctttacacaaagcccagacggagttcttactttaaaatgtttaaccccactaacaaccacaggcgggtctctacagttaaaagtgggagggggtcttacaatagatgacaccgacggttttttgaaagaaaacataagtgccgccacaccactcgttaagactggtcactctataggtttgtcgctaggacccggattaggaacaaatgaaaacaaactttgtgccaaattgggagaaggacttacattcaattccaacaacatttgcattgatgacaatattaacaccctatggacaggagttaaccccaccacagccaactgtcaaataatggcctccagtgaatctaatgattgcaaattaattctaacactagttaaaactggagcccttgtcactgcatttgtttatgttataggagtatctaacgattttaatatgctaactacacataaaaatataaatttcactgcagagctgttttttgattctactggtaatttactaactagcctttcatccctaaaaactccacttaatcataaatcagggcaaaacatggctactggtgcccttactaatgctaaaggtttcatgcccagcacaactgcctatcctttcaatgttaattccagagaaaaagaaaactacatttacggaacttgttactacacagctagtgatcacactgcttttcccattgacatatctgtcatgcttaaccaaagagcattaaataatgagacatcatattgtattcgtgtaacttggtcctggaacacaggagttgccccagaagtgcaaacctctgctactaccctagtcacctctccatttaccttttactacattagagaagacgactga

SEQ ID NO: 134 - DNA, 1062 bp, Adenovirus B16
  MISC_FEATURE (1)..(1062): Fiber Gene
atggccaaacgagctcggctaagcagctccttcaatccggtctacccctatgaagatgaaagcagctcacaacacccctttataaaccctggtttcatttcctcaaatggttttgcacaaagcccagatggagttctaactcttaaatgtgttaatccactcactaccgccagcggacccctccaacttaaagttggaagcagtcttacagtagatactatcgatgggtctttggaggaaaatataactgccgcagcgccactcactaaaactaaccactccataggtttattaataggatctggcttgcaaacaaaggatgataaactttgtttatcgctgggagatgggttggtaacaaaggatgataaactatgtttatcgctgggagatgggttaataacaaaaaatgatgtactatgtgccaaactaggacatggccttgtgtttgactcttccaatgctatcaccatagaaaacaacaccttgtggacaggcgcaaaaccaagcgccaactgtgtaattaaagagggagaagattccccagactgtaagctcactttagttctagtgaagaatggaggactgataaatggatacataacattaatgggagcctcagaatatactaacaccttgtttaaaaacaatcaagttacaatcgatgtaaacctcgcatttgataatactggccaaattattacttacctatcatcccttaaaagtaacctgaactttaaagacaaccaaaacatggctactggaaccataaccagtgccaaaggcttcatgcccagcaccaccgcctatccatttataacatacgccactgagaccctaaatgaagattacatttatggagagtgttactacaaatctaccaatggaactctctttccactaaaagttactgtcacactaaacagacgtatgttagcttctggaatggcctatgctatgaatttttcatggtctctaaatgcagaggaagccccggaaactaccgaagtcactctcattacctcccccttctttttttcttatatcagagaagatgactga

SEQ ID NO: 135 - DNA, 972 bp, Adenovirus B21
  MISC_FEATURE (1)..(972): Fiber Gene
atgaccaagagagtccggctcagtgattccttcaaccctgtctacccctatgaagatgaaagcacctcccaacacccctttataaacccagggtttatttccccaaatggctttacacaaagcccagacggagttcttactttaaattgtttaaccccactaacaaccacaggcgggcctttacagttaaaagtgggagggggacttatagtggatgacactgatgggaccttacaagaaaacatacgtgctacagcacccattactaaaaataatcattctgtagaactatccattggaaatggattagaaacacaaaacaataaactatgtgccaaattgggaaatgggttaaaatttaacaacggtgacatttgtataaaggatagtattaacaccttatggactggaataaagcctccacctaactgtcaaattgtggaaaacactgatacaaacgatggcaaacttactttagtattagtaaaaaacggagggcttgttaatggctacgtatctctagttggtgtatcagacactgtgaaccaaatgttcacacaaaagtcagcaaccatacaattaagattatatttcgactcttctggaaatctattaactgatgaatcaaacttaaaaattccacttaaaaataaatcttctacagcaaccagtgaagctgcaaccagcagcaaagcctttatgccaagtactacagcttatccctttaacaccactactagggatagtgaaaactatattcatggaatatgttactatatgactagttatgatagaagtctagttcccttaaacatttctataatgctaaacagccgtacgatttcttccaatgttgcctatgccatacaatttgaatggaatctaaatgcaaaagaatctccagaaagcaacatagctacgctgaccacatccccctttttcttttcttatattagagaagacgacaactaa

SEQ ID NO: 136 - DNA, 972 bp, Adenovirus B50
  MISC_FEATURE (1)..(972): Fiber Gene
atgaccaagagagtccggctcagtgattccttcaaccctgtctacccctatgaagacgaaagcacctcccaacacccctttataaacccagggtttatttccccaaatggctttacacaaagcccagacggagttcttactttaaattgtttaaccccactaacaaccacaggcgggcctttacagttaaaagtgggagggggacttatagtggatgacactgatgggaccttacaagaaaacatacgtgttacagcacccattactaaaaataatcattctgtagaactatccattggaaatggattagaaacacaaaacaataaactatgtgccaaattgggaaatgggttaaaatttaacaacggtgacatttgtataaaggatagtattaacaccttatggactggaataaagcctccacctaactgtcaaatagtggaaaacactgatacaaacgatggcaaacttactttagtattagtaaaaaacggaggacttgttaatggctacgtatctctagttggtgtatcagacactgtgaaccaaatgttcacacaaaagtcagcaaccatacaattaagattatatttcgactcttctggaaatctattaactgatgaatcaaacttaaaaattccacttaaaaataaatcttctacagcaaccagtgaagctgcaaccagcagcaaagcctttatgccaagtactacagcttatccctttaacaccactactagggatagtgaaaactatattcatggaatatgttactatatgactagttatgatagaagtctagttcccttaaacatttctataatgctaaacagccgtacgatttcttccaatgttgcctatgccatacaatttgaatggaatctaaatgcaaaagaatctccagaaagcaacatagctacgctgaccacatccccctttttcttttcttatattagagaagacgacaactaa

SEQ ID NO: 137 - DNA, 978 bp, Adenovirus B11
  MISC_FEATURE (1)..(978): Fiber Gene
atgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactga

SEQ ID NO: 138 - DNA, 978 bp, Adenovirus B14a
  MISC_FEATURE (1)..(978): Fiber Gene
atgaccaagagagtccggctcagtgactccttcaaccctgtctacccctatgaagatgaaagcacctcccaacacccctttataaacccagggtttatttccccaaatggcttcacccaaagcccagacggagttcttactttaaaatgtttaaccccgctaacaaccacaggcgggtctctacagctaaaagtgggagggggacttacagtagatgacactgatgggaccttacaagaaaacataggtgccaccacaccacttgttaagactgggcactctataggtttatccctaggagccggattgggaacagatgaaaataaactttgtaccaaattgggagaaggacttacattcaattcaaacaacatttgcattgatgacaatattaacaccctgtggacaggagttaaccccaccgaagccaactgtcaaatgatggactccagtgaatctaatgattgcaaattaattctaacactagttaaaactggagccctagtcactgcatttgtttatgttataggagtatctaacaattttaatatgctaactacatacagaaatataaattttactgcggagctgttttttgattctgcgggtaatttactaactagcctgtcatccctaaaaactccacttaatcataaatcaggacaaaacatggctactggtgccattactaatgctaaaagtttcatgcccagcacaactgcttatcctttcaataataattctagagaaaaagaaaactacatttacggaacttgtcactacacagctagtgatcacactgcttttcccattgacatatctgtcatgcttaaccaaagagcaataagagctgatacatcatattgtattcgtataacttggtcctggaacacaggagatgccccagaggggcaaacctctgctacaaccctagttacctccccatttaccttttactacatcagagaagacgactga

SEQ ID NO: 139 - DNA, 978 bp, Adenovirus B14b; identical to SEQ ID NO: 138
  MISC_FEATURE (1)..(978): Fiber Gene

SEQ ID NO: 140 - DNA, 972 bp, Adenovirus B34
  MISC_FEATURE (1)..(972): Fiber Gene
atgaccaagagagtccggctcagtgactccttcaaccctgtctacccctatgaagatgaaagcacctcccaacacccctttataaacccagggtttatttccccaaatggcttcacacaaagcccagacggagttcttactttaaaatgtttaaccccactaacaaccacaggcggatctctacagctaaaagtgggagggggacttacagtggatgacactgatggtaccttacaagaaaacatacgtgctacagcacccattactaaaaataatcactctgtagaactatccattggaaatggattagaaactcaaaacaataaactatgtgccaaattgggaaatgggttaaaatttaacaacggtgacatttgtataaaggatagtattaacaccttatggactggaataaaccctccacctaactgtcaaattgtggaaaacactaatacaaatgatggcaaacttactttagtattagtaaaaaacggagggcttgttaatggctacgtgtctctagttggtgtatcagacactgtgaaccaaatgttcacacaaaagacagcaaacatccaattaagattatattttgactcttctggaaatctattaactgatgaatcagacttaaaaattccacttaaaaataaatcttctacagcgaccagtgaaactgtagccagcagcaaagcctttatgccaagtactacagcttatcccttcaacaccactactagggatagtgaaaactacattcatggaatatgttactacatgactagttatgatagaagtctatttcccttgaacatttctataatgctaaacagccgtatgatttcttccaatgttgcctatgccatacaatttgaatggaatctaaatgcaagtgaatctccagaaagcaacatagctacgctgaccacatccccctttttcttttcttacattacagaagacgacaactaa

SEQ ID NO: 141 - DNA, 972 bp, Adenovirus B35
  MISC_FEATURE (1)..(972): Fiber Gene
atgaccaagagagtccggctcagtgactccttcaaccctgtctacccctatgaagatgaaagcacctcccaacacccctttataaacccagggtttatttccccaaatggcttcacacaaagcccagacggagttcttactttaaaatgtttaaccccactaacaaccacaggcggatctctacagctaaaagtgggagggggacttacagtggatgacactgatggtaccttacaagaaaacatacgtgctacagcacccattactaaaaataatcactctgtagaactatccattggaaatggattagaaactcaaaacaataaactatgtgccaaattgggaaatgggttaaaatttaacaacggtgacatttgtataaaggatagtattaacaccttatggactggaataaaccctccacctaactgtcaaattgtggaaaacactaatacaaatgatggcaaacttactttagtattagtaaaaaatggagggcttgttaatggctacgtgtctctagttggtgtatcagacactgtgaaccaaatgttcacacaaaagacagcaaacatccaattaagattatattttgactcttctggaaatctattaactgaggaatcagacttaaaaattccacttaaaaataaatcttctacagcgaccagtgaaactgtagccagcagcaaagcctttatgccaagtactacagcttatcccttcaacaccactactagggatagtgaaaactacattcatggaatatgttactacatgactagttatgatagaagtctatttcccttgaacatttctataatgctaaacagccgtatgatttcttccaatgttgcctatgccatacaatttgaatggaatctaaatgcaagtgaatctccagaaagcaacatagctacgctgaccacatccccctttttcttttcttacattacagaagacgacaactaa

SEQ ID NO: 142 - DNA, 1749 bp, Adenovirus C1
  MISC_FEATURE (1)..(1749): Fiber Gene
atgaagcgcgccagaccgtctgaagacaccttcaaccccgtgtacccttatgacacggaaaccggccccccaacagtgcctttccttacccctccctttgtctcccccaatgggttccaagaaagtccccctggggtgctttctctgcgcctttccgaaccactcgtcacctcccacggcatgcttgcgctcaaaatgggcagcggcctagccctggacaaggccggcaaccttacatcacaaaatataaccaccgtcactgagccattaaaaaaaacaaagtccaacataagcctggaaacctccgcgcccctcacagttacatcaggcattcttaccgtagccactgccgcacctttggtggtcgcgggcaacagtcttaccgtgcagtcacaggccccgttaaccgtgcaagactctaaacttagcattgccaccaaaggacccctcacagtgtcagaaggaaagctggccctgcaaacatcgggccccctttctgccactgataacaacacccttactattactacttcaccccctataactactacaaatggtagtttgggtgttaacatggaaaacccactttacaacaacaatggcaaactggggctcagagttgcaggtcctttgcaagtgaccaacgactctcacgcactaacagtaggtacaggtcagggtgttgccattgataataatgcgctacacacaaaagttacaggcgcaatagggtatgatacatctggtaacatggaacttaaaactggagggggagtgcgtgtagacagtgtaaataggcgtcttatactcgatgttgattatccatttgatgcccaaagccaactacgcctaaaactaggacagggacccctatatgtaaactcaagcacacacaacttggatttaaactacaataaaggccttcacttgtttacaactggaaactctaaaaagctagaagtaaatcttaaaacaacaaagggtcttatttttgacaccgatgctgttgcaatacatgcagcacaaggtctagaatttggtaatgatacgtcaacaaatacaaacccacttaaaacaaaactaggattgggattggactatgactcaaacggtggtatgattcccaaacttggaacaggccttagttttgatactacaggggctataacagtgggaaacaaaagcgatgacaaacttaccctgtggacaactcctgacccatcacctaattgtcaaatacactcagaaaaagatgctaagctaacactagttttaactaaatgcggcagtcaggtacttgcaactgtgtcagcactggctgtaaggggcagcctagctcctattagcggaacaataagtagtgctcacattattctcagatttaatgaacatggagtgctaatgaatcattctagtttggatccccaatactggaatttcagaaaaggggatttaacaaacgctacagcatatactaacgcagttggttttatgcccaaccttaaagcttacccaaaaactcaaagtagaactgcaaaaagcaacattgttagtcaggtttatcttaatggagaaaaagaaaaaccaatgacactcactattacacttaatggaactgatgaaaatcaaaccactcccgccagtacatactcaatttcattttcatggagctggcctagcaatcaaacatacattggtcaaacatttgccactaattcctacaccttctcctacattgcccaagaataa

SEQ ID NO: 143 - DNA, 1749 bp, Adenovirus C2
  MISC_FEATURE (1)..(1749): Fiber Gene
atgaaacgcgccagaccgtctgaagacaccttcaaccccgtgtatccatatgacacagaaaccgggcctccaactgtgccctttcttacccctccatttgtttcacccaatggtttccaagaaagtccccctggagttctctctctacgcgtctccgaacctttggacacctcccacggcatgcttgcgcttaaaatgggcagcggtcttaccctagacaaggccggaaacctcacctcccaaaatgtaaccactgttactcagccacttaaaaaaacaaagtcaaacataagtttggacacctccgcaccacttacaattacctcaggcgccctaacagtggcaaccaccgctcctctgatagttactagcggcgctcttagcgtacagtcacaagccccactgaccgtgcaagactccaaactaagcattgctactaaagggcccattacagtgtcagatggaaagctagccctgcaaacatcagcccccctctctggcagtgacagcgacacccttactgtaactgcatcacccccgctaactactgccacgggtagcttgggcattaacatggaagatcctatttatgtaaataatggaaaaataggaattaaaataagcggtcctttgcaagtagcacaaaactccgatacactaacagtagttactggaccaggtgtcaccgttgaacaaaactcccttagaaccaaagttgcaggagctattggttatgattcatcaaacaacatggaaattaaaacgggcggtggcatgcgtataaataacaacttgttaattctagatgtggattacccatttgatgctcaaacaaaactacgtcttaaactggggcagggacccctgtatattaatgcatctcataacttggacataaactataacagaggcctatacctttttaatgcatcaaacaatactaaaaaactggaagttagcataaaaaaatccagtggactaaactttgataatactgccatagctataaatgcaggaaagggtctggagtttgatacaaacacatctgagtctccagatatcaacccaataaaaactaaaattggctctggcattgattacaatgaaaacggtgccatgattactaaacttggagcgggtttaagctttgacaactcaggggccattacaataggaaacaaaaatgatgacaaacttaccctgtggacaaccccagacccatctcctaactgcagaattcattcagataatgactgcaaatttactttggttcttacaaaatgtgggagtcaagtactagctactgtagctgctttggctgtatctggagatctttcatccatgacaggcaccgttgcaagtgttagtatattccttagatttgaccaaaacggtgttctaatggagaactcctcacttaaaaaacattactggaactttagaaatgggaactcaactaatgcaaatccatacacaaatgcagttggatttatgcctaaccttctagcctatccaaaaacccaaagtcaaactgctaaaaataacattgtcagtcaagtttacttgcatggtgataaaactaaacctatgatacttaccattacacttaatggcactagtgaatccacagaaactagcgaggtaagcacttactctatgtcttttacatggtcctgggaaagtggaaaatacaccactgaaacttttgctaccaactcttacaccttctcctacattgcccaggaataa

SEQ ID NO: 144 - DNA, 1746 bp, Adenovirus C5
  MISC_FEATURE (1)..(1746): Fiber Gene
atgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataa

SEQ ID NO: 145 - DNA, 1587 bp, Adenovirus C6
  MISC_FEATURE (1)..(1587): Fiber Gene
atgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataa

SEQ ID NO: 146 - DNA, 1089 bp, Adenovirus D8
  MISC_FEATURE (1)..(1089): Fiber Gene
atgacaaagagactccgggtggaagatgacttcaaccccgtctacccctatggctacgcgcggaatcaaaatattcccttcctcactcccccctttgtctcctccaatggatttcaaaacttcccccctggggtcctgtcacttaaactggctgacccaatcaccattaacaatcaaaatgtatcactcaaggttggaggggggctaactttgcaagaagaaactggaaaattaacagttaatactgaaccacctttgcatcttacaaataacaaattagggatagctttagacgctccatttgatgttatagacaataagcttacactattagcaggccatggcttgtctattataacaaaagaaacatcaacactgcctggcttggttaatactcttgtagtattaactggaaagggtattggaacagatttatcaaataatggtggaaatatatgtgttagagttggagaaggcggcggcttatcatttaatgacaatggagacttggtagcatttaataaaaaagaagacaaacgcaccctatggacaactccagacacatctccaaattgcagaattgatcaggataaggactctaagctaactttggtccttacaaagtgtggaagtcaaatattagccaatgtgtcattaattgttgtagctggaaggtacaaaattatcaataacaatactaatccagctcttaaaggatttaccattaaattgttgtttgataaaaatggagtccttatggaatcttcaaatcttggtaaatcatattggaactttcgaaatcaaaattcaattatgtcaacagcttatgaaaaagctattggttttatgcctaatttggtagcctatccaaaacctaccactggctctaaaaaatatgcaagagatatagtttatggaaacatctaccttggcggaaagccacatcaaccagtaaccattaaaactacctttaaccaggaaactggatgtgaatactctattacatttgattttagttgggccaaaacttatgtaaatgttgaatttgaaactacctcttttaccttttcctatattgcccaagaataa

SEQ ID NO: 147 - DNA, 1089 bp, Adenovirus D9
  MISC_FEATURE (1)..(1089): Fiber Gene
atgtcaaagaggctccgggtggaagatgacttcaaccccgtctacccctatggctacgcgcggaatcagaatatccccttcctcactcccccctttgtctcctccgatggattccaaaacttcccccctggggtcctgtcactcaaactggctgacccaatagccatcgtcaatgggaatgtctcactcaaagtgggagggggtctcactttgcaagatggaactggaaaactaacagtcaatgctgatccacctttgcaacttacaaacaacaaattagggattgctttggacgctccatttgatgttatagacaataaactcacattgttagcgggccatggcttgtctattataacaaaagaaacatcaacactgcctggcttgattaatactcttgtagtattaactggaaagggtattggaacagaatcaacagataatggcggaagcgtatgtgttagagttggagaaggtggcggcttatcatttaataatgatggagacttggtagcatttaataaaaaagaagataagcgcaccctatggacaactccagacacatctccaaattgcaagattgatcaagataaggactctaagttaactctggtccttacaaagtgtggaagtcaaatattggctaatgtgtcattaattgtcgtagctggtaagtacaaaattatcaataacaatactcaaccagctctcaaaggatttaccattaaattattgtttgatgaaaatggagtacttatggaatcttcaaatcttggtaaatcatattggaactttagaaatgaaaattcaattatgtcaacagcttatgaaaaagctattggattcatgcctaatttggtagcctatccaaaacctaccgctggctctaaaaaatatgcaagagatatagtttatggaaacatctaccttggtggaaagccagatcaaccagtaaccattaaaactacctttaatcaggaaactggatgtgaatattctatcacatttgattttagttgggccaagacttatgtaaatgttgaatttgaaacaacctcttttaccttttcctatatcgcccaagaatga

SEQ ID NO: 148 - DNA, 1104 bp, Adenovirus D10
  MISC_FEATURE (1)..(1104): Fiber Gene
atggcaaagaggctccgggtggaagatgacttcaaccccgtctacccctatggctacgcgcggaatcagaatatccccttcctcactcccccctttgtctcctccgatggattccaaaacttcccccctggggtcctgtcactcaaactggctgacccaatcgctatcaccaatgggaatgtctcactcaaggtgggagggggacttactgtagagcaacagactggaaacctaagtgtgaaccctgccgcccccttgcaagttgcaagtgataagctacagcttgtcctagctcctccatttgaggtaaaagacggaaaactttcattaaaaacaggcaatggattaaaagtaatagataaaagcatcacagacctaccaggattaatagatacacttgctgttttaactggaaagggaattggaacagaagaactaaaaaatgaaaatggaactaataaaggtgttggtttgcgcgttagactcgctgatgacggtggattaacatttgatgaaaagggtgacctcgtagcatggaatgttaagcatgacactcgcaccctttggacaacaccagacacttctccaaactgcacaattgctcaggataaggactctaaactaactcttgttcttacaaagtgcggaagtcaaatattggcaaatgtgtctttgattgtggtcgcaggaaagtaccacatcataaataataagaataatccagaaataaaaagttttactattaaacttctatttgataagaacggagtgcttttagacaactcaaatcttggaaaaacttattggaactttagaagtggagattccaatgtttcgacagcttatgaaaaagcaattggttttatgcctaatttggtagcgtatccgaaacccagtaattctaaaaaatatgcaagagacatagtttatggaactatatatcttggtggaaaacctgatcagccagcagtcattaaaactacctttaaccaagaaactggatgtgaatactctataacatttgactttagttggtccaaaacctatgaaaatgttgaatttgaaaccacctcttttaccttctcctatatcgcccaacaatga

SEQ ID NO: 149 - DNA, 1146 bp, Adenovirus D13
  MISC_FEATURE (1)..(1146): Fiber Gene
atggcaaagaggctccgggtggaagatgacttcaaccccgtctacccctatgactacgcgcggaatcagaatatccccttcctcactcccccctttgtctcctccgatggattcaaaaacttcccccctggggtcctgtcactcaaactggctgacccaatcaccatagccaatggtgatgtctcactcaaggtgggagggggacttactttgcaagaaggaagtctgactgtagaccctaaggctcccttgcaacttgcaaatgataaaaaacttgagcttgtttatgatgatccatttgaggttagcaccaataaacttagtttaaaagtaggacatggattaaaagtattagatgacaaaagtgctggagggttgaaagatttaattggcaaacttgtggttttaacaggaaaaggaataggtattgaaaatttgcaaaacgacgatggtagtagcagaggggttggtataaatgtaagactcggcacagatggaggtctgtcctttgacaggaaaggtgaattagtagcttggaacagaaaagatgacaggcgaaccctttggacaacacctgatccatcgcccaattgtaaagccgaaacagaaaaggactcaaagcttactttggttctaacaaaatgcggaagtcaaatcttagctactgtgtctattattgttcttaagggtaaatatgaatttgttaaaaaagaaacagagcctaagtcctttgatgttaaattgctgtttgacagcaaaggagtgcttctaccaacttcaaatctttccaaagaatattggaactatagaagttatgataacaacataggaactccttatgaaaatgcagttccatttatgccaaatctaaaagcttatccaaaaccaactaaaactgcttcagataaagcagaaaataaaataagcagtgctaaaaacaaaattgtaagcaacttctactttggagggcaagcatatcaacctgggacaataataattaagtttaatgaggaaatagatgagacatgtgcatactctatcacctttaactttggttggggcaaggtatatgacaatccatttccatttgataccacctcttttaccttctcttatattgcccaagaaaatgaagacaaagactaa

SEQ ID NO: 150 - DNA, 1101 bp, Adenovirus D17
  MISC_FEATURE (1)..(1101): Fiber Gene
atgtcaaagaggctccgggtggaagatgacttcaaccccgtctacccctatggctacgcgcggaatcagaatatccccttcctcactcccccctttgtctcctccgatggattcaaaaacttcccccctggggtcctgtcactcaaactggctgacccaatcaccatagccaatggtgatgtctcactcaaggtgggagggggacttactttgcaagaaggaagtctgactgtagaccctaaggctcccttgcaacttgcaaacaataaaaaacttgagcttgtttatgttgatccatttgaggttagtgccaataaacttagtttaaaagtaggacatggattaaaaatattagatgacaaaagtgctggagggttgaaagatttaattggcaaacttgtggttttaacagggaaaggaataggcactgaaaatttgcaaaatacagatggtagcagcagaggaattggtataagtgtaagagcaagagaagggttaacatttgacaatgatggatacttggtagcatggaacccaaagtatgacacgcgcacactttggacaacaccagacacatctcctaattgcaggattgataaggagaaggattcaaaactcactttggtacttacaaagtgtggaagtcaaatattagctaatgtgtctttgattgtggtgtcaggaaaatatcaatacatagaccacgctacaaatccaactcttaaatcatttaaaataaaacttctttttgataataaaggtgtacttctcccaagttcaaaccttgattccacatattggaactttagaagtgacaatttaactgtatctgaggcatataaaaatgcagttgaatttatgcctaatttggtagcctacccaaaacctaccactggctctaaaaaatatgcaagggatatagtctatgggaacatatatcttggaggtttggcatatcagccagttgtaattaaggttacttttaatgaagaagcagatagtgcttactctataacatttgaatttgtatggaataaagaatatgccagggttgaatttgaaaccacttcctttaccttctcctatattgcccaacaataa

SEQ ID NO: 151 - DNA, 1140 bp, Adenovirus D20
  MISC_FEATURE (1)..(1140): Fiber Gene
atgtcaaagaggctccgggtggaagatgacttcaaccccgtctacccctatggccacgcgcggaatcagaatatccccttcctcactcccccctttgtctcctccgatggattacaaaacttcccccctggtgtcctttcgctaaaactggctgatccaatcgccattgtcaatgggaatgtttcactcaaggtgggagggggaatcactgtggaacaagatagtggacagctaattgcgaatcctaaggctcccttgcaagttgcaaatgacaaattagagctttcttatgcatatccatttgaaactagtgctaataaacttagtttaaaagtagggcaaggactaaaagtgttggatgaaaaagattctggaggattgcaaaatttacttggcaaacttgtagttttaactggaaaaggaataggtgttgaagagttaaaaaaccctgataatactaataggggagttggaattaatgtaagactgggcaaagatggaggtttgtcctttaataaaaatggtgagttagtagcgtggaacaaacacaatgacacacgcactctttggacaactccagacccttctccaaattgtaaaattgaggaagttaaagactcaaaacttactttggttcttacaaaatgcggaagtcagatattggctactatggcttttcaagttgtgaagggaacttatgaaaatatcagtaagaacacagcaaaaaatagcttctcaattaaattgttatttgatgataatggaaaacttttagaaggatctagtttagataaagattattggaacttcagaagtgatgattctattatacccaatcaatacgacaatgcagtgccgtttatgccaaacctaaaagcttatcctaaaccttcaactgtcttgccatctactgacaaaaatagtaatgggaaaaatactattgtttctaacctttatctggaaggaaaggcatatcagccagttgcggttaccattacttttaacaaagagattggctgtacttattcaataacatttgactttggatgggctaaaacctatgatgttccaattccatttgattcttcctcatttaccttctcctatattgcccaagaaaacaaagacacgaacaaataa

SEQ ID NO: 152 - DNA, 1146 bp, Adenovirus D24
  MISC_FEATURE (1)..(1146): Fiber Gene
atgacaaagaggctccgggtggaagatgacttcaaccccgtctacccctatggctacgcgcggaatcagaatatccccttccttactcccccctttgtttcttccgatggattccaaaacttcccacctggggtcctgtcactcaaactggctgacccaatcgccatcactaatggggatgtttcactcaaggtgggagggggtcttactgttgaaaaagatagtggaaatctaaaggtgaaccctaaggctcccttgcaagttacaactgataaacagttggaaattgcactggcttatccatttgaagtcagtaatggcaagcttggcataaaagcaggtcatggattgaaagtcattgacaaaattgctggtttggaaggtttggcaggtacgcttgtagttttgactggaaaaggaataggtactgaaaatcttgaaaacagtgatgggtcaagtagaggagttggtataaacgtaagacttgctaaagatggaggtctgtcttttgataaaaagggtgatttagttgcttggaataaacatgatgacagacgcactctatggacaactcccgacccatccccaaattgtacaatcgatcaggaaagggattcaaagctcactttagtattaacaaaatgtggcagtcaaattttggctaatgtctctttacttgttgtaaaaggaaaatttagtaacataaacaataatactaatccaactgataaaaaaatcacagtaaagctactttttaatgaaaagggagtattaatggacagttcgacacttaagaaagaatattggaactacagaaatgataattctactgtatctcaggcctatgataatgcagttccttttatgccaaacataaaagcttatcctaaacctaccacagacacttcggctaaaccagaagataaaaaaagtgctgctaaaagatacattgtgagcaatgtctatattggaggcttgccagataaaactgttgttataactattaagtttaatgcagaaactgaatgtgcttattcgattacctttgaattcacatgggcaaaaacctttgaagatgtgcagtttgattcctcctcttttaccttttcctatattgcccaagaaaatgaggacgaagacaaataa

SEQ ID NO: 153 - DNA, 1098 bp, Adenovirus D25
  MISC_FEATURE (1)..(1098): Fiber Gene
gtggaagatgacttcaaccccgtctacccctatggctacgcgcggaatcagaatatccccttcctcactcccccctttgtctcctccgatggattccaaaactttccccctggtgtgctgtcactcaaattggctgacccaatcactatcagtaatggcgatgtctcactcaaggtgggagggggactcactgtggaacaagatagtggaaacctaagtgtgaaccctaaggctccattgcaagttggaacagacaaaaaactggaattggctttagcacctccatttaatgttaaagataacaagctagatctgctagtaggagatggattaaaggtaatagataaatcaatatctgaattgccaggattgttaaactatcttgtagttttgactggcaaaggaattggaaatgaagaattaaaaaatgacgatggtagcaataaaggagtcggtttatgtgtgagaattggagaaggaggtggtttaacttttgatgataaaggttatttagtagcatggaacaagaaacatgacatccgcacactttggacaactttagacccttctccaaattgtagaattgatgtggacaaggactctaaactaacattggtccttacaaagtgcggaagtcagatattggctaatgtatctcttcttgttgtcaaaggaaggtttcaaaacctaaattacaaaacaaacccaaaccttcctaaaacatttacaataaaattactgtttgatgaaaatgggattcttaaagactcatcaaatcttgacaagaactattggaactatagaaacggaaattctattttagcagagcaatataaaaatgcagttggctttatgccaaatttagcagcttatcccaaatctaccaccactcagtctaaactttatgcaagaaacactatttttggaaatatttacctagattcgcaagcatataatccagtggttattaaaattacttttaatcaagaagcagatagtgcttattctatcactttaaactattcatggggtaaggattatgaaaatatcccttttgattctacttcttttaccttttcctatatcgcccaagaatga

SEQ ID NO: 154 - DNA, 1125 bp, Adenovirus D26
  MISC_FEATURE (1)..(1125): Fiber Gene
atggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaa

SEQ ID NO: 155 - DNA, 1104 bp, Adenovirus D27
  MISC_FEATURE (1)..(1104): Fiber Gene
atgtcaaagaggctccgggtggaagatgacttcaaccccgtctacccctatggctacgcgcggaatcagaatatccccttcctcactcctccctttgtctcctccgatggattcaaaaacttccccccaggggtcctgtcactcaaactggctgacccaatcaccataactaatggagatgtctcgctcaaggtgggagggggacttgttgtggaaaaagagtctggaaagctaagtgttgaccctaagactcccttgcaagttgcaagtgacaacaaattggagctttcttataatgctccatttaaagttgaaaatgacaagctatcacttgatgtaggccacggattaaaagttataggcaatgaagtatcaagcttgcctggattaataaataagcttgttgttttaactgggaagggaattggcactgaagagttaaaagaacaaaacagtgataaaataataggagttggaattaatgtaagagcaagaggaggattgtcatttgacaatgatggctacttagtagcttggaatccaaagtatgatacacgtacactttggacaactccagacacatctcctaattgcaagatgcttacaaaaaaggactcaaagcttacactcacacttacaaagtgcggaagtcaaattttaggaaacgtatctttacttgctgtttcgggaaagtatcttaatatgacaaaggacgaaacaggagttaagataattttactatttgacagaaatggagttcttatgcaggaatcatcactcgataaagaatattggaactatagaaatgacaataatgttatcggaactccttatgaaaatgcagtggggtttatgccaaacttagtggcatatcctaaaccgacaagtgcagatgcaaaaaactattcaagaagcaagataataagtaatgtatacttaaagggtcttatatatcaaccagtaattataattgccagttttaatcaggaaaccactaatggttgtgtctattctatttcatttgatttcacctgttcaaaggattacactggccaacaatttgatgttacctcattcactttctcctatatcgcccaagaatga

SEQ ID NO: 156 - DNA, 1149 bp, Adenovirus D33
  MISC_FEATURE (1)..(1149): Fiber Gene
atgtcaaagaggctccgggtggaagatgacttcaaccccgtctacccctatggctacgcgcggaatcagaatatccccttcctcactcccccctttgtctcctccgatggattccaaaacttcccccctggtgtcctgtcactcaaactggctgacccaatcaccatcgccaatgggaatgtttcactcaaggtgggagggggactcactctggaacaagatagtggaaagctaattgtgaatcctaaggctcccttgcaagttgcaaatgacaaattagagctttcttacgcagatccatttgaaactagtgctaataaacttagtttaaaagtagggcatggactaaaagtgttggatgagaaaaatgctggaggattgaaagatttaattggcacacttgtagttttaactggaaaaggaataggcgttgaagagttaaaaaacgctgataatactaataggggagttggaattaatgtaagactgggtaaagatggaggtttgtcctttgataaaaaaggcgacttagtagcttggaataagcatgatgacagacgcactttatggacaactccagacccatctccaaattgtacaattgatgaggaaagagattcaaagctcactttagtgttaacaaaatgcggtagtcaaattttggccaatgtctctttacttgttgtaaaaggaaaatttagtaacataaacaataatactaatccaactgataaaaaaatcacagtgaagctactttttaatgaaaagggagtattaatggacagttcgtcacttaaaaaagaatattggaactacagaaatgataattctactgtatctcaggcctatgataatgcagttccttttatgccaaacataaaagcttatcctaaacctaccacagacacttcagctaaaccagaagataaaaaaagtgctgctaaaagatacattgtgagcaatgtctatattggaggcttgccagataaaactgttgttataactattaagttgaatgcagaaactgaatctgcttattcaatgacctttgaatttacatgggcaaaaacatttgaaaatttgcagtttgattcctcctcttttaccttctcctatattgctcaagaaaatgaggacgaagacaaataa

SEQ ID NO: 157 - DNA, 1098 bp, Adenovirus D37
  MISC_FEATURE (1)..(1098): Fiber Gene
atgtcaaagaggctccgggtggaagatgacttcaaccccgtctacccctatggctacgcgcggaatcagaatatccccttcctcactcccccctttgtctcctccgatggattcaaaaacttcccccctggggtactgtcactcaaactggctgatccaatcaccattaccaatggggatgtatccctcaaggtgggaggtggtctcactttgcaagatggaagcctaactgtaaaccctaaggctccactgcaagttaatactgataaaaaacttgagcttgcatatgataatccatttgaaagtagtgctaataaacttagtttaaaagtaggacatggattaaaagtattagatgaaaaaagtgctgcggggttaaaagatttaattggcaaacttgtggttttaacaggaaaaggaataggcactgaaaatttagaaaatacagatggtagcagcagaggaattggtataaatgtaagagcaagagaagggttgacatttgacaatgatggatacttggtagcatggaacccaaagtatgacacgcgcacactttggacaacaccagacacatctccaaactgcacaattgctcaagataaggactctaaactcactttggtacttacaaagtgtggaagtcaaatattagctaatgtgtctttgattgtggtcgcaggaaagtaccacatcataaataataagacaaatccaaaaataaaaagttttactattaaactgctatttaataagaacggagtgcttttagacaactcaaatcttggaaaagcttattggaactttagaagtggaaattccaatgtttcgacagcttatgaaaaagcaattggttttatgcctaatttggtagcgtatccaaaacccagtaattctaaaaaatatgcaagagacatagtttatggaactatatatcttggtggaaaacctgatcagccagcagtcattaaaactacctttaaccaagaaactggatgtgaatactctatcacatttaactttagttggtccaaaacctatgaaaatgttgaatttgaaaccacctcttttaccttctcctatattgcccaagaatga

SEQ ID NO: 158 - DNA, 1116 bp, Adenovirus D69
  MISC_FEATURE (1)..(1116): Fiber Gene
atgtcaaagaggcttcgggtggaagatgacttcaaccccgtctacccctatgactacgcgcggaatcagaatatccccttcctcactcccccctttgtctcctccgatggattccaaaacttcccccctggtgtcctgtcactcaaattggctgacccaatcgctatcaccaatggtgatgtctcactcaaggtgggagggggacttactttacaagatggaaccggaaaactaactatcgacaccaagactcccttgcaagttgcaaataataaattagaacttgcgtttgatgcaccattgtatgaaaaaaatggaaaacttgctttaaaaacaggccatggattagctgttttaaccaaagacattggcataccagaattaattggatcccttgtgatcttaactggaaaaggaattgggacaggtactgttgcaggaggaggaactatagatgtaagactgggtgatgatggaggtttatcatttgataaaaagggtgatctagtagcctggaataaaaaaaatgacaggcgcactttgtggacaacacctgatccatccccaaactgcagagtatcagaagataaagattcaaaactaactttaattcttacaaaatgtggaagtcagatcctagcaagtttttcactgcttgtagtcaaagggacgtatgcaactgttgataaaaatacaactaataaacaatttagcattaaactactgtttgatgcaaatggaaagcttaaaagcgaatcaaaccttagtggttattggaactatagaagtgataatagtgttgttagtactccctatgacaatgcagtgcctttcatgccaaataccacggcttatccaaaaatcattaatagtacaactgatcctgaaaataagaaaagttcggctaaaaaaactattgttggcaatgtctacctagaaggtaatgcgggtcaaccagtagccgttgctattagtttcaataaggaaactactgctgactattcaataacatttgactttgcgtggagcaaagcttatgaaacccctgtgccttttgacacctcctccatgacattctcatatattgcccaggaaaatcaagacaaaggcgaataa

SEQ ID NO: 159 - DNA, 1278 bp, Adenovirus E4
  MISC_FEATURE (1)..(1278): Fiber Gene
atgtccaaaaagcgcgcgcgggtggatgatggcttcgaccccgtgtatccctacgatgcagacaacgcaccgaccgtgcccttcatcaaccctcccttcgtctcttcagatggattccaagaaaagcccctgggggtgttgtcccttaggctggccgaccctgtcaccaccaagaatggggaaattaccctcaagctgggggagggggtggaccttgacgactcgggaaaactcattgcaaacacagtaaacaaggccattgcccctctcagtttttccaacaacaccatttcccttaacatggatacccctttatacaccaaagatggaaaactatccttacaagtttctccaccattaagtatattaaaatcaacaattttgaatacattagctctagcttttggctcaggtttaggactcagtggcagcgccctggcagtacagttagcctctccacttacatttgatgataaagggaatataaagattaccctaaacaggggattgcatgttacaacaggagatgcaattgaaagcaacatcagttgggctaaaggtataaaatttgaagatggtgccatagctacaaacattggtaaggggctagagttcggaaccagtagtacagaaacaggagttaataatgcttatccaatccaagttaaacttggctctggtctcagctttgacagcacaggagccataatggctggcaataaagactatgataaattaactttgtggacaacgcctgacccatcaccaaactgtcaaatacttgcagaaaatgatgcaaaactaacactttgcttaactaagtgtgacagtcaaatactggccactgtatcagttttggttgttagaagtggaaacttaaacccaattactggcacagtaagcagtgctcaagtttttctacgttttgatgcaaatggtgttcttttaacagaacactctacactaaaaaaatactggggctacaagcaaggagatagcatagatggcactccatacaccaatgctgttggttttatgccaaattcaacagcttatccaaagacccaaagttctactactaaaaataatatagtgggtcaagtatacatgaatggagatgtttcaaaacccatgcttcttactataactcttaatggtactgatgacaccaccagtgcatactcaatgtcattttcatacacctggactaacggaagctatatcggagcaacatttggagctaactcatacaccttctcctacatagcccaacaataa

SEQ ID NO: 160 - DNA, 1683 bp, Adenovirus G52
  MISC_FEATURE (1)..(1683): Fiber Gene
atgaaacgggccagagttgatgaagacttcaacccagtgtacccttatgaccccccacatgctcccgttatgcccttcattactccaccttttacctcctcggatgggttacaggaaaaaccacttggagtgttaagtttaaactacagagatcccattactacgcaaaatgggtctcttacaattaaactaggaaacggcctcactctagacaaccagggacaactaacatcaaccgctggggaagtagaacctccactcactaacgctaacaacaaacttgcactggtctatagggaacctttagcagtaaagcgcaacagcctaaccttatcgcacaccgctccccttgttattgctgataactctttagcattgcaagtttcagagcctatttttataaatgacaaggacaaactagccctgcagacagccgcgccccttgtaactaacgctggcacccttcgcttacagagcgccgcccctttaggcattgcagaccaaaccctaaaactcctgtttaccaaccctttgtacttgcagaataactttctcacgttagccattgaacgaccccttgccattaccaatactggaaagctggctctacagctctccccaccgctacaaacagcagacacaggcttgactttgcaaaccaacgtgccattaactgtaagcgacgggaccctaggcttagccataaagcgcccacttattgttcaggacaacaacttgtttttggacttcagagctcccctgcgtcttttcaacagcgaccccgtactagggcttaacttttacacccctcttgcagtgcgcgatgaggcgctcactgttaacacaggccgcggcctcacagtgagttacgatggtttaattttaaatcttggtaaggatcttcgcttcgacaacaacaccgtttctgtcgctcttagtgctgctttgcctttacaatacactgatcagcttcgccttaacgtgggcgctgggctgcgttacaatccagtgagtaaaaaattggacgcgaaccccaatcaaaacaagggtttaacctgggaaaatgactacctcattgtaaagctaggaaatggattaggttttgatggcgatggaaacatagctgtttctcctcaagttacatcgcctgacaccttatggaccactgccgatccatcccccaattgttccatctacactgatttagatgccaaaatgtggctctcgttggtaaaacaagggggtatggttcacggttctgttgctttaaaagcattgaaaggaaccctattgagtcctacggaaagtgccattgttattatactacattttgacaattatggagtgcgaattctcaattatcccactttgggcactcaaggcacgttgggaaataatgcaacttggggttataggcagggagaatctgcagacactaatgtactcaatgcactagcatttatgcccagttcaaaaaggtacccaagagggcgtggaagcgaagttcagaatcagactgtgggctacacttgtatacagggtgacctttctatgcccgtaccgtaccaaatacagtacaactatggaccaactggctactcctttaaatttatttggagaactgtttcaagacaaccatttgacatcccatgctgttttttctcttacattacggaagaataa

SEQ ID NO: 161 - DNA, 1494 bp, Adenovirus A12
  MISC_FEATURE (1)..(1494): Fiber Gene
atgaggcgcgcggtggaactgcagacagtggcttttcctgagacaccacctccctcttacgaaaccgtgatggcagcggcgccaccctacgtgcctccccgctatttgggtcctacggagggaagaaacagtatccgttactcggaattgtcaccgttgtacgataccactcgagtgtacttggtggacaacaagtcttctgacattgcttcattgaattaccagaatgatcacagcaactttttaaccactgtagtgcaaaataatgactattcccctatagaggctggcacgcaaactattaactttgatgaaaggtctagatggggtggagatttaaaaaccatcttacataccaacatgccaaacgtgaacgattttatgtttaccaccaaatttaaggccagggtaatggtggctaggaaaacaaacaacgaaggccaaaccattttagaatatgagtgggcagaatttgtgctacccgagggtaactattcggaaaccatgactattgacttaatgaacaatgctattattgagcattatttgcgagtaggaagacagcatggagtgctggaaagtgacattggagttaagtttgacaccagaaactttcgtctgggttgggaccccgaaacccaattagtaactccgggagtgtacactaatgaggcttttcatccagatatagtactgcttccaggttgcggggttgattttacagagagcagattaagcaacatactaggtataagaaagaggcagccgtttcaggaaggatttgtgattatgtatgaacacttagagggaggcaatattccagctcttttggatgtaaaaaaatacgaaaacagtctgcaggatcaaaacactgtaagaggagacaactttattgccttaaataaggctgctaggattgaaccggttgaaacagaccccaaaggacgcagttacaacttgcttccagacaaaaaaaatactaaatatcgcagctggtatttggcatacaactacggagacccagaaaaaggagttcggtcatggactctactaacaactccagatgtaacaggcggctccgaacaggtgtactggtccctacccgatatgatgcaagatccggtgacttttcgctcctcgcgtcaagttagcaactatcctgtagttgcagcagaattactgccagttcatgctaaaagcttctacaacgagcaagccgtctactcacagcttattcgccagtcaaccgcgcttacgcgcgtgtttaatcgctttcccgagaaccagatactggtgcgtccaccagccgctaccatcactaccgtcagtgaaaacgttcccgcccttacagatcacgggaccctgccgctgcgtagcagtatcagtggagttcagcgagtcaccatcactgacgcccgccgccggacctgtccctacgtttacaaagcactgggcatagtttctccacgagtgctttctagtcgcactttttaa

SEQ ID NO: 162 - DNA, 1524 bp, Adenovirus A18
  MISC_FEATURE (1)..(1524): Penton Gene
atgaggcgtgcggtggaactccagccagtggcttttgctgaggcgccacctccctcttatgaaaccgtgatggcagcagcggcagcccaaccttctacactggaagcaccctacgtgcctccccgatacttgggtcctacggagggaagaaacagtatccgttattcagaattatccccattgtatgataccactcgggtgtatctggtggataacaaatcatctgacattgcttcgctgaattaccaaaacgatcacagcaactttttaactactgtggtgcagaataacgactactcccctattgaggccggcacgcagactattaactttgatgaacggtctcgttggggtggggatttgaaaacaatactgcgtaccaacatgccaaatgtgaacgatttcatgttcacaaccaaatttaaagctaaggttatggttgccagggaaaaaaataaagaagatccatccaaagatattttgaagtatgaatgggcagaatttgttttgcctgagggtaactattctgaaaccatgaccattgatctaatgaataacgccattattgagcactacctgttagtaggaagacaaaatggagtgctggaaagcgacataggagttaagtttgacacgagaaactttcgcctgggctgggaccccgagactaaacttattacgccgggtgtttacacaaatgaggcgtttcacccagacatagtactcttgcctggatgcggcgttgactttacagagagcagattaagtaacgttcttggcattaggaagcgccagccttttcaggaaggatttattattatgtatgaggacttagagggaggaaacattccggctcttctggatgtaaaaaagtacgaagacagcctgaagaatgagagcgccataagaggagacaattttactgcgttgatgaaagtcgctacaattgaaccagtggcagcggattccaaagggcgcagttacaacttgcttccagacaaaaaaaatactgagtatcgcagctggtacttggcatacaactacggagactcagaaaaaggggtccggtcttggactctcttaactaccccagatgtcacaggcggctctgagcaggtgtactggtcactaccggacatgatgcaagatccggtgactttccgctcgtcgcgtcaagttagcaactacccggtagttgcggcagaactgttaccggttcacgctaaaagtttctacaacgatcaagccgtctactcgcagctcattcgccagtcaaccgcgcttacacacgtgtttaatcgctttcccgagaaccagatattggtgcgcccaccagccgctaccatcactaccgtcagtgaaaacgttcccgccctcacagatcacggaaccctgccgctgcgcagcagtatcagtggagttcagcgagtcaccatcactgacgcccgccgccggacctgtccctacgtttacaaagcactgggcatagtttcaccacgtgtgctttctagtcgcactttttaa

SEQ ID NO: 163 - DNA, 1518 bp, Adenovirus A31
  MISC_FEATURE (1)..(1518): Penton Gene
atgaggcgcgcggtggaactgcagacagtggcttttcccgaggcaccaccaccctcttacgaaaccgtgatggcagcagctcaaacttccgcactggaagctccctacgtgcctccccgctatttggctcctacggagggaagaaatagcattcgttattcagaattgtcaccgttatacgataccactcgagtgtacttagtggacaacaagtcttctgatatcgcttctttaaactaccaaaatgatcacagcaactttctaaccactgtagtccaaaacaacgactattcccctatagaagccggtacacaaactattaattttgacgaaaggtcccgatggggcggtgatttgaaaactattttgcatactaacatgcccaacgtaaatgattttatgtttacaactaaatttaaggccagggtaatggtgtctagaaaaaaagatagtgaagaccagtccaaagacattttgaaatacgagtgggcagaatttgtgttacccgaaggtaactactcggaaaccatgactatcgacttaatgaacaacgcaatcatcgagcattacttgcgagttggccgtcagaacggtgtgctagaaagcgacattggagttaagtttgacaccagaaactttcgcctgggttgggaccccgaaactaaattagtgactccgggagtgtatactaacgaggcttttcatccagatatagtattgctaccaggatgcggagtggacttcacggagagcagattaagcaacatgctgggaatcagaaaaagacagccttttcaggagggttttgttatcatgtatgaagacttagaagggggaaatatcccagcgcttttagatgttaaaaaatacgaagacagcttgcagccagacaacaccgtaagaggtgacaactttattgccttaaacaaggccgcaaaaatcgaagcagtcgaggctgattccaaaggccgaagttacaacttgcttcccgacaaaaaaaatactaagtaccgtagctggtatttggcatacaactatggagatccagaaaaaggtgttcgttcttggactcttctaacaaccccagacgtgacaggcggttccgagcaggtctattggtcgcttcccgatatgatgcaagatccggtgacttttcgctcctcgcgtcaagtcagcaactatccggtagttgcggccgaactaatgccggttcacgccaaaagcttctacaacgaacaagccgtctactcacagcttatccgccagtcaaccgcgcttacacacgtgtttaatcgctttcccgagaaccagatactagtgcgtccaccagctgctaccatcactaccgtcagtgaaaacgttcccgctctcacagatcacgggaccctgccgctgcgtagcagtatcagtggagttcagcgagtcaccatcactgacgcccgccgccggacctgtccttacgtttacaaagcactgggcatagtttctccacgagtactttctagtcgcactttctaa

SEQ ID NO: 164 - DNA, 1635 bp, Adenovirus B3
  MISC_FEATURE (1)..(1635): Penton Gene
atgaggagacgagccgtgctaggcggagcggtggtgtatccggagggtcctcctccttcttacgagagcgtgatgcagcaacaggcggcgatgatacagcccccactggaggctcccttcgtacccccacggtacctggcgcctacggaagggagaaacagcattcgttactcggagctgtcgcccctgtacgataccaccaagttgtatctggtggacaacaagtcggcggacatcgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaagctcctgaaggtgttacagtaaatgacacctatgatcataaagaggatatcttgaagtatgagtggtttgagttcattttaccagaaggcaacttttcagccaccatgacgatcgacctgatgaacaatgccatcattgacaactacctggaaattggcagacagaatggagtgctggaaagtgacattggtgttaagtttgacactagaaatttcaggctcgggtgggaccccgaaactaagttgattatgccaggtgtctacacttatgaggcattccatcctgacattgtattgctgcctggttgcggggtagactttactgaaagccgacttagcaacttgcttggcatcaggaagagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgatgatataactagaggagatacctatataactgaaaaacaaaaacgtgaagctgcagctgctgaagttaaaaaagagttaaagatccaacctctagaaaaagacagcaagagtagaagctacaatgtcttggaagacaaaatcaacacagcctaccgcagttggtacctgtcctacaattacggtaaccctgagaaaggaataaggtcttggacactgctcaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttctaa

SEQ ID NO: 165 - DNA, 1563 bp, Adenovirus B7
  MISC_FEATURE (1)..(1563): Penton Gene
atgcagcaacaggcggcgatgatacagcccccactggaggctcccttcgtacccccgcggtacctggcgcctacggaagggagaaacagcattcgttactcggagctgtcgcccctgtacgataccaccaagttgtatctggtggacaacaagtcggcggacatcgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaggctcctgaaggtgttatagtaaatgacacctatgatcataaagaggatatcttaaagtatgagtggtttgagttcactttaccagaaggcaacttctcagccaccatgaccattgacctgatgaacaatgccatcattgacaactacctggaaattggcagacaaaatggagtgctggaaagtgacattggtgttaagtttgacactagaaactttaggctcgggtgggaccccgaaactaagttaattatgccaggagtctacacttatgaggcattccatcctgacattgttttgctgcctggctgcggggtagactttactgaaagccgacttagcaacttgcttggcatcaggaaaagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgataatataactagaggagatacctatataactgaaaaacaaaaacgtgaagctgcagctgctgaagttaaaaaagagttaaagatccaacctctagaaaaagacagcaagagtagaagctacaatgtcttggaagacaaaatcaacacggcctaccgcagctggtacctgtcctacaattacggtaaccctgagaaaggaataaggtcttggacactgcttaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttttaa

SEQ ID NO: 166 - DNA, 1668 bp, Adenovirus B16
  MISC_FEATURE (1)..(1668): Penton Gene
atgaggagacgagccgtgctaggcggagcggtggtgtatccggagggtcctcctccttcttacgagagcgtgatgcagcaacaggcggcgatgatacagcccccactggaggctcccttcgtaccccctcggtacctggcgcctacggaagggagaaatagcattcgttactcggagctgtcaccccagtacgataccaccaagttgtatctggcggacaacaagtcggcggacatcgcctccctgaactatcagaacgaccacagcaacttcctgaccacagtggtgcagaacaatgactttacccccacggaggctagcacccagaccattaactttgacgagcggtcgcggtggggcggtcagctgaagaccattatgcacaccaacatgcccaacgtgaacgagtacatgttcagcaacaagtttaaggcgagggtgatggtatctaggaaggctcctgaaggtgttacagtaaatgatcataaagatgatattttgaaatatgagtggtttgagttcactttaccagaaggtaacttctcagctaccatgaccatcgacctgatgaacaatgccatcattgacaactacctgaaaattggcagacagaatggagtgctggaaagtgacattggtgttaagtttgacactagaaacttcaggctcgggtgggaccccgaaactaagttgattatgccaggggtctacacttatgaggcattccatcctgacattgttttgttgcctggttgcggggtagattttactgaaagccgacttagcaacttgcttggcatcaggaagagacatccattccaggagggtttcaaaatcatgtatgaagatcttgaagggggtaatattcctgcccttttggatgtcactgcctatgaggaaagcaaaaaggataccactactgaaacaggcgaaaaggcggtggttaaaacaaccacagtggctgttgcagaggaaaccagtgaagatgataatataactagaggagatacttatataactgaaaaacaaaaacgtgaagctgcagctgcagaactattacttatgtctgaagttaaaaaagagttaaagatccaacctttagaaaaagacagcaagaatagaagctacaatgtcttggaagacaaaatcaacacagcctaccgcagctggtacctgtcctacaattatggtaaccctgagaaaggaataaggtcctggacactgctcaccacttcggatgtcacctgtggagccgagcaggtctactggtcgctccccgacatgatgcaagaccccatcaccttccgctcctcgagacaagtcaacaactacccagtagtgggtgcagagcttatgccggtcttctcaaagagtttctacaatgagcaagccgtgtactctcagcagctccgacagtccacctcgctcacgcacgtcttcaaccgcttccctgagaaccagatcctcatccgcccgccggcgcccacaattaccaccatcagtgaaaacgttcctgctctcacagatcacgggaccctgccgttacgcagcagtatccggggagtccagcgcgtgaccgttactgacgccagacgtcgcacctgtccctacgtttacaaggccctgggcatagtcgcgccgcgcgttctttcaagccgcactttctaa

SEQ ID NO: 167 - DNA, 1686 bp, Adenovirus B21
  MISC_FEATURE (1)..(1686): Penton Gene
atgatgaggcgaaccgtgctaggcggagcggtggtgtatccggagggtcctcctccttcgtacgagagcgtgatgcagcaggcggcggcggcgacgatgcagccaccactggaggctccctttgtaccccctcggtacctggcacctacggaggggagaaacagcattcgttactcggagctggcaccattgtatgataccacccggttgtatttggtggacaacaagtccgcggacatcgcctcactgaactatcagaacgaccacagcaacttcctcaccacggtggtgcaaaacaatgactttacccccacggaggccagcacccagaccatcaactttgacgagcggtcgcgatggggcggtcagctgaagactatcatgcacaccaacatgcccaacgtgaacgagtacatgtttagcaacaagttcaaagctcgggtgatggtgtctagaaaggctcctgaaggtgtcacagtagatgacaattatgatcacaagcaggatattttggaatatgagtggtttgagtttactctaccggaagggaatttctcagccacaatgaccattgacctaatgaacaatgccatcattgataattaccttgaagtgggcagacagaatggagtgttagagagtgacattggtgttaaatttgacaccaggaactttagactgggttgggatccggaaactaagttgattatgcctggggtttacacctatgaggcattccatcctgacattgtattgttgcctggttgcggagttgactttactgaaagtcgccttagtaacttgcttggtatcaggaaaagacacccattccaggagggttttaagatcttgtatgaggatcttgaagggggtaatatcccggccctgttggatgtagaagcctatgagaacagtaagaaagaacaagaagccaaaacagaagccgctaaagctgctgctattgctaaagccaacatagttgtcagcgaccctgtaagggtggctaatgcagaagaagtcagaggagacaactatacagcttcatctgttgcaactgacgaatcgctattggctgctgtggccgaaactacagagacaaaactcactattaaacctgtagaaaaagacagcaagagtagaagttacaatgtcttggaagataaagtgaatacagcctaccgcagctggtacctgtcctacaactatggtgaccctgaaaaaggagtccgttcctggacactgctcaccacctcggatgtcacctgtggagcagagcaggtgtactggtcgctcccagacatgatgcaggaccctgtcacattccgttccacgagacaagtcagcaactatccagtggtaggtgcagagctcatgccggtcttctcaaagagtttctacaacgagcaagccgtgtactcccagcagcttcgccagtccacctcgctcacgcacgtcttcaaccgcttccctgagaaccagatcctcatccgcccgccagcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctttcaagccgcactttctaa

SEQ ID NO: 168 - DNA, 1686 bp, Adenovirus B50
  MISC_FEATURE (1)..(1686): Penton Gene
atgatgaggcgaaccgtgctaggcggagcggtggtgtatccggagggtcctcctccttcgtacgagagcgtgatgcagcaggcggcggcggcggcgatgcagccaccactggaggctccctttgtaccccctcggtacctggcacctacggaggggagaaacagcattcgttactcggagctggcaccattgtatgataccacccggttgtatttggtggacaacaagtccgcggacatcgcctcactgaactatcagaacgaccacagcaacttcctcaccacggtggtgcaaaacaatgactttacccccacggaggccagcacccagaccatcaactttgacgagcggtcgcgatggggcggtcagctgaagactatcatgcacaccaacatgcccaacgtgaacgagtacatgtttagcaacaagttcaaagctcgggtgatggtgtctagaaaggctcctgaaggtgtcacagtagatgacaattatgatcacaagcaggatattttggaatatgagtggtttgagtttactctaccggaagggaacttctcagccacaatgaccattgacctaatgaacaatgccatcattgataattaccttgaagtgggcagacagaatggagtgttggagagtgacattggtgttaaatttgacaccaggaactttagactgggttgggatccggaaactaagttgattatgcctggggtttacacctatgaggcattccatcctgacattgtattgttgcctggttgcggagttgactttactgaaagtcgccttagtaacttgcttggtatcaggaaaagacacccattccaggagggttttaagatcttgtatgaggatcttgaagggggtaatatcccggccctgttggatgtagaagcctataagaacagtaagaaagaacgagaagccaaaacagaagccgctaaagctgctgctattgctaaagccaacatagttgtcagcgaccctgtaagggtggctaatgccgaagaagtcagaggagacaactatacagcttcatctgttgcaactgaagaatcgctattggctgctgtggccgaaactacagagaccaaactcactattaaacctgtagaaaaagacagcaagagtagaagttacaatgtcttggaagataaagtgaatacagcctaccgcagctggtacctgtcctacaactatggtgaccctgaaaaaggagtccgttcctggacactgctcaccacctcggatgtcacctgtggagcagagcaggtgtactggtcgctcccagacatgatgcaggaccctgtcacattccgttccacgagacaagtcagcaactatccagtggtaggtgcagagctcatgccggtcttctcaaagagtttctacaacgagcaagccgtgtactcccagcagcttcgccagtccacctcgctcacgcacgtcttcaaccgcttccctgagaaccagatcctcatccgcccgccagcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctttcaagccgcactttctaa

SEQ ID NO: 169 - DNA, 1698 bp, Adenovirus B11
  MISC_FEATURE (1)..(1698): Penton Gene
gtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaa

SEQ ID NO: 170 - DNA, 1608 bp, Adenovirus B14a
  MISC_FEATURE (1)..(1608): Penton Gene
atgcagcagcagcaggcgacggcggtgatgcaatccccactggaggctccctttgtacctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcagaacaatgactttacccctacggaagccagtacccagaccattaactttgatgaacgatcgcggtggggcggtcagctaaagaccatcatgcatactaacatgcccaacgtaaacgagtatatgtttagtaacaacttcaaagcgcgtgtgatggtgtccagaaaacctcccgaaggtgctgcagttggggatacatatgatcacaagcaggatattttggaatatgagtggttcgagtttactttgccagaaggcaacttttcagttactatgaccattgatttgatgaacaatgccatcatagataactacttgaaagtgggcagacagaatggagtgcttgaaagtgacattggtgttaagttcgacaccaggaacttcaagctgggatgggatcccgaaaccaagttgattatgcctggagtgtatacgtatgaagcctttcatcctgacattgtcttactgcctggctgtggagtggactttaccgaaagtcgtttgagcaaccttcttggtatcagaaaaaaacagccatttcaagagggttttaagattttgtatgaagatttagaaggaggtaatattccggccctcttggatgtagatgcctatgagaacagtaagaaagaacaaaaagccaaaatagaagctgctgcggaagctaaggcaaacatagttgccagcgactctacaagggttgctaacgctggagaggtcagaggagacaattttgcaccaacacctgttccgactgcagaatcattattggccgatgtaactggaggaacggacgtgaaactcactattcaacctgtagaaaaagatagtaagaatagaagctataatgtgttggaagataaaatcaacacagcctatcgcagttggtacctttcgtacaattatggcgatcccgaaaaaggagtgcgttcctggacattgctcaccacctcagatgtcacctgcggagcagagcaggtctactggtcgcttccagacatgatgcaggatcctgtcactttccgctccactagacaagtcagcaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaa

SEQ ID NO: 171 - DNA, 1677 bp, Adenovirus B14b
  MISC_FEATURE (1)..(1677): Penton Gene
atgaggcgagtcgtgctaggcggagcggtggtgtatccggagggtcctcctccttcgtacgagagcgtgatgcagcagcagcaggcgacggcggtgatgcaatccccactggaggctccctttgtacctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcagaacaatgactttacccctacggaagccagtacccagaccattaactttgatgaacgatcgcggtggggcggtcagctaaagaccatcatgcatactaacatgcccaacgtaaacgagtatatgtttagtaacaacttcaaagcgcgtgtgatggtgtccagaaaacctcccgaaggtgctgcagttggggatacatatgatcacaagcaggatattttggaatatgagtggttcgagtttactttgccagaaggcaacttttcagttactatgaccattgatttgatgaacaatgccatcatagataactacttgaaagtgggcagacagaatggagtgcttgaaagtgacattggtgttaagttcgacaccaggaacttcaagctgggatgggatcccgaaaccaagttgattatgcctggagtgtatacgtatgaagcctttcatcctgacattgtcttactgcctggctgtggagtggactttaccgaaagtcgtttgagcaaccttcttggtatcagaaaaaaacagccatttcaagagggttttaagattttgtatgaagatttagaaggaggtaatattccggccctcttggatgtagatgcctatgagaacagtaagaaagaacaaaaagccaaaatagaagctgctgcggaagctaaggcaaacatagttgccagcgactctacaagggttgctaacgctggagaggtcagaggagacaattttgcaccaacacctgttccgactgcagaatcattattggccgatgtaactggaggaacggacgtgaaactcactattcaacctgtagaaaaagatagtaagaatagaagctataatgtgttggaagataaaatcaacacagcctatcgcagttggtacctttcgtacaattatggcgatcccgaaaaaggagtgcgttcctggacattgctcaccacctcagatgtcacctgcggagcagagcaggtctactggtcgcttccagacatgatgcaggatcctgtcactttccgctccactagacaagtcagcaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaa

SEQ ID NO: 172 - DNA, 1677 bp, Adenovirus B34
  MISC_FEATURE (1)..(1677): Penton Gene
atgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaaaaccatcatgcatactaacatgcccaacgtgaacgagtatatgtttagtaacaagttcaaagcgcgtgtgatggtgtccagaaaacctcctgagggtgttagagtagacgataattatgatcataagcaagatattctaaaatacgagtggttcgagtttactttgccagaaggcaacttttcggtcactatgactatcgacttgatgaacaatgccatcatagacaattacttgaaagtgggcagacagaatggagtgttggaaagtgacattggtgttaagttcgacactaggaacttcaagttgggatgggatccagaaactaagttgatcatgcctggggtttacacctatgaggccttccatcctgacatcgtattgctgcctggctgcggagtggactttaccgaaagccgtctgagcaaccttcttggcattagaaagaaacacccattccaagagggttttaagatcttgtatgaggatttagaaggaggaaatattccagcccttttggatgtagatgcttatgagaacagcaagaaagatcaaaaagccaaaatagaagctgctgcagaagctaaagcaaacatagttgccaacgatccggtaagggtggctaacgctagtgaaatcaggggagacagttttgccgcaacatccgttccgactaaagaatcattattggatgatgtgtctcaaaacatagagttaaaactcactattaagcctgtggaaaaagatggcaaaaacagaagttacaatgtgttggaagataaaatcaacacggcctatcgcagttggtacctttcgtacaattatggcgaccccgaaaaaggagtgcgttcctggacattgctcaccacctcagatgtcacctgcggagcggagcaggtctactggtcgcttccagacatgatgcaggatcctgtcactttccgctccactagacaagtcagtaactaccctgtggtgggtgcagagcttatgcccgtcttttcaaagagcttctacaacgaacaagctgtgtactcccagcagctccgccagtccacctcgcttacgcacgtcttcaaccgctttcctgagaaccagattttaatccgtccgccggcgcccacaattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaa

SEQ ID NO: 173 - DNA, 1698 bp, Adenovirus B35
  MISC_FEATURE (1)..(1698): Penton Gene
gtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcagaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttggaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtttactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaa

SEQ ID NO: 174 - DNA, 1725 bp, Adenovirus C1
  MISC_FEATURE (1)..(1725): Penton Gene
atgcggcgcgcggcgatgtatgaggaaggtcctcctccctcctacgagagcgtggtgagcgcggcgccagtggcggcggcgctgggttcccccttcgatgctcccctggacccgccgttcgtgcctccgcggtacctgcggcctaccggggggagaaacagcatccgttactctgagttggcacccctattcgacaccacccgtgtgtaccttgtggacaacaagtcaacggatgtggcatccctgaactaccagaacgaccacagcaactttctaaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgctcgcttactaaggacaaacaggtggagctgaaatatgagtgggtggagttcacgctgcccgagggcaactactccgagacaatgaccatagaccttatgaacaacgcgatcgtggagcactacttgaaagtgggcaggcagaacggggttctggaaagcgacatcggggtaaagtttgacacccgcaacttcagactggggtttgacccagtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgacctggagggtggtaacattcccgcactgttggatgtggacgcctaccaggcaagcttgaaagatgacaccgaacagggcgggggtggcgcaggcggcggcaacaacagtggcagcggcgcggaagagaactccaacgcggcagccgcggcaatgcagccggtggaggacatgaacgatcatgccattcgcggcgacacctttgccacacgggcggaggagaagcgcgctgaggccgaggcagcggccgaagctgccgcccccgctgcggaggctgcacaacccgaggtcgagaagcctcagaagaaaccggtgattaaacccctgacagaggacagcaagaaacgcagttacaacctaataagtaatgacagcaccttcacccagtaccgcagctggtaccttgcatacaactacggcgaccctcaggccgggatccgctcatggaccctgctttgcactcctgacgtaacctgcggctcggagcaggtatactggtcgttgcccgacatgatgcaagaccccgtgaccttccgctccacgagccagatcagcaactttccggtggtgggcgccgagctgttgcccgtgcactccaagagcttctacaacgaccaggccgtctactcccagctcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttga

SEQ ID NO: 175 - DNA, 1716 bp, Adenovirus C2
  MISC_FEATURE (1)..(1716): Penton Gene
atgcagcgcgcggcgatgtatgaggaaggtcctcctccctcctacgagagcgtggtgagcgcggcgccagtggcggcggcgctgggttcccccttcgatgctcccctggacccgccgtttgtgcctccgcggtacctgcggcctaccggggggagaaacagcatccgttactctgagttggcacccctattcgacaccacccgtgtgtaccttgtggacaacaagtcaacggatgtggcatccctgaactaccagaacgaccacagcaactttctaaccacggtcattcaaaacaatgactacagcccgggggaggcaagcacacagaccatcaatcttgacgaccgttcgcactggggcggcgacctgaaaaccatcctgcataccaacatgccaaatgtgaacgagttcatgtttaccaataagtttaaggcgcgggtgatggtgtcgcgctcgcttactaaggacaaacaggtggagctgaaatatgagtgggtggagttcacgctgcccgagggcaactactccgagaccatgaccatagaccttatgaacaacgcgatcgtggagcactacttgaaagtgggcaggcagaacggggttctggaaagcgacatcggggtaaagtttgacacccgcaacttcagactggggtttgacccagtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgacctggagggtggtaacattcccgcactgttggatgtggacgcctaccaggcaagcttaaaagatgacaccgaacagggcggggatggcgcaggcggcggcaacaacagtggcagcggcgcggaagagaactccaacgcggcagccgcggcaatgcagccggtggaggacatgaacgatcatgccattcgcggcgacacctttgccacacgggcggaggagaagcgcgctgaggccgaggcagcggcagaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccgggatccgctcatggaccctcctttgcactcctgacgtaacctgcggctcggagcaggtctactggtcgttgccagacatgatgcaagaccccgtgaccttccgctccacgagccagatcagcaactttccggtggtgggcgccgagctgttgcccgtgcactccaagagcttctacaacgaccaggccgtctactcccagctcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttga

SEQ ID NO: 176 - DNA, 1470 bp, Adenovirus D8
  MISC_FEATURE (1)..(1470): Penton Gene
atggctcctacggagggcagaaacagcattcgttactcggagctggctccgcagtacgacaccactcgcgtgtacttggtggacaacaagtcggcggacatcgcttccctcaactaccaaaacgaccacagcaacttcctaaccacggtggtgcagaacaacgatttcacccccgccgaggccagcacgcagacgataaattttgacgagcggtcccggtggggcggtgatctgaagaccattttgcacaccaacatgcccaatgtgaacgagtacatgttcaccagcaagtttaaggcgcgggtgatggtggctaggaagcacccacagggggtagctgaaacagatttaagtcaggataagcttgaatatgagtggtttgagtttaccctgcccgagggcaatttttccgagaccatgaccatagacctgatgaacaacgccatcttggaaaactacttgcaagtggggcggcaaaatggcgtgctggagagcgatattggagttaagtttgacagcagaaatttcaagctgggctgggacccggtgactaagctggtgatgccgggggtctacacatacgaggccttccatcccgacgtggtgctgctgccgggctgcggggtggacttcaccgagagccgcctgagcaaccttctgggcattcgcaagaagcaacctttccaagagggcttcaggattatgtatgaggatctagaagggggcaacatccccgccctgctggatgtggaagcatacctcaaaagcaagaatgatcgggaggaagccacccagaatgcaaacagagttgctgcaaatggaggtggtgaaattaggggagatacttttcttaccaccgaacagctaagagccgctgacaaggagctggttattaagcccattaaggaagatgctagcaagagaagctataatgtcataggggacacccatgacaccctgtaccgcagctggtacctgtcctatacctacggggaccccgagaagggggtacagtcgtggacgctgctcaccaccccggacgtcacctgcggcgcggagcaagtctactggtcgctgccggacctcatgcaagaccccgtcaccttccgctccacccagcaagtcagcaactaccccgtggttggcgccgagctcatgcccttccgcgccaagagcttttacaacgatctcgccgtctactcccagctcatccgcagctacacctccctcacccacgtcttcaaccgcttccccgacaaccagatcctgtgtcgcccgcccgcgcccaccatcaccaccgttagtgaaaacgtgcctgctctcacagatcacgggacgctaccgctgcgcagcagtatccgcggagtccagcgagtgaccgttactgacgcccgtcgccgcacctgtccctacgtctacaaggccctgggcatagtcgcgccgcgcgtgctctctagtcgcaccttttaa

SEQ ID NO: 177 - DNA, 1560 bp, Adenovirus D9
  MISC_FEATURE (1)..(1560): Penton Gene
atgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtggctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcaaaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggctacagccgatacaaccactaggggtgatacatttggaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgtcacctgcggcgcggagcaagtctactggtcgctgccggacctcatgcaagacccagtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaa

SEQ ID NO: 178 - DNA, 1560 bp, Adenovirus D10
  MISC_FEATURE (1)..(1560): Penton Gene
atgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtggctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcaaaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaa

SEQ ID NO: 179 - DNA, 1554 bp, Adenovirus D13
  MISC_FEATURE (1)..(1554): Penton Gene
atgaggcgcgcggtggtgtctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcccggtggggcggtgatctgaagaccattctgcacaccaacatgcccaatgtgaacgagtacatgttcaccagcaagtttaaggcgcgggtgatggtggctaggaagcatccagagggggtagaagcaaccgatttaagcaaggatatcttagagtatgattggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtgaccaagctggtgatgccaggtgtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagtagggggcaatatcccagccctcctggatgtcaagaagtatctgaaggataaggaagaagctggcactacagatgcaaataccattaaggctcagaatgatgcagtcccaagaggagacaactttgcttcagcggcagatgccaaagcggcaggaaaagaaattgagttgaaagccattttaaaagatgattcaggcagaagctacaatgtgatcgagggaaccacggacaccctgtaccgaagttggtacctgtcctatacctacggggaccccgagaagggggtgcagacgtggacgctgctcactaccccggacgtcacctgcggcgcggagcaagtctactggtcgctgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaa

SEQ ID NO: 180 - DNA, 1458 bp, Adenovirus D17
  MISC_FEATURE (1)..(1458): Penton Gene
atggctcctacggagggcagaaacagcattcgttactcggagctggctccgttgtacgacaccactcgcgtgtacttggtggacaacaagtcggcggacatcgcttccctgaactatcaaaacgaccacagcaacttcctgaccacggtggtgcagaacaacgatttcacccccgccgaggctagcacgcagacgataaattttgacgagcggtcgcggtggggcggtgatctgaagaccattctgcacaccaacatgcccaatgtgaacgagtacatgttcaccagcaagtttaaggcgcgggtgatggtggctagaaaacacccacagggggtagaagcaacagatttaagcaaggatatcttagagtatgagtggtttgagtttaccctgcccgagggcaacttttccgagaccatgaccatagacctgatgaacaacgccatcttggaaaactacttgcaagtggggcggcaaaatggcgtgctggagagcgatattggagtcaagtttgacagcagaaatttcaagctgggctgggaccctgtgaccaagctggtgatgccaggggtctacacctacgaggcctttcacccggacgtggtgctgctgccgggctgcggggtggacttcacagagagccgcctgagcaacctcctgggcattcgcaagaagcaacctttccaagagggcttcagaatcatgtatgaggatctagaagggggcaacatccccgccctgctggatgtgcccaagtacttggaaagcaagaagaagttagaggaggcattggagaatgctgctaaagctaatggtcctgcaagaggagacagtagcgtctcaagagaggttgaaaaggcagctgaaaaagaacttgttattgagcccatcaagcaagatgatagcaagagaagttacaacctcatcgagggaaccatggacacgctgtaccgcagctggtacctgtcctatacctacggggaccctgagaagggggtgcagtcgtggacgctgctcaccaccccggacgtcacctgcggcgcggagcaagtctactggtcgctgccggacctcatgcaagaccccgtcaccttccgttctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgtccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgtgtgctttccagtcgcaccttctaa

SEQ ID NO: 181 - DNA, 1560 bp, Adenovirus D20
  MISC_FEATURE (1)..(1560): Penton Gene
atgaggcgtgcgatggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtacttggtggacaacaagtcggcggacatcgcttccctgaactaccaaaacgaccacagcaacttcctgaccacggtggtgcagaacaacgatttcacccccgccgaggctagcacgcagacgataaattttgacgagcggtcgcggtggggcggtgatctgaagaccattctgcacaccaacatgcccaatgtgaacgagtacatgttcaccagcaagtttaaggcgcgggtgatggtggctaggaagcacccagatggtgtagacaaagatgatttaagcaaggatatcttagagtatgagtggtttgagtttaccctgcccgagggcaacttttccgagaccatgaccatagacctgatgaacaacgccatcttggaaaactacttgcaagtggggcggcaaaatggcgtgctggagagcgatattggagtcaagtttgacagcaggaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagtagggggcaacatccccgccctcctgaatgtcaaggagtatctgaaggataaggaagaagctggcacagcagatgcaaataccattaaggctcagaatgatgcagtcccaagaggagataactatgcatcagcggcagaagccaaagcagcaggaaaagaaattgagttgaaggccattttgaaagatgattcaaacagaagctacaatgtgatcgagggaaccacagacaccctgtaccgcagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggttggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgcttccgctgcgcagcagtatccgcggagtccagcgagtgaccgtcactgacgcccgtcgccgcacctgtccctacgtctacaaggccctgggcatagtcgcgccgcgcgtgctatccagtcgcaccttctaa

SEQ ID NO: 182 - DNA, 1545 bp, Adenovirus D24
  MISC_FEATURE (1)..(1545): Penton Gene
atgaggcgcgcggtggtgtcttcctctcctcctccctcgtacgagagcgtgatggcgcaggcaaccctggaggttccgtttgtgcctccgcggtatatggctcctacggagggcagaaacagcattcgttactcggaactggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatttgaagaccattctgcacaccaacatgcccaatgtgaacgagtacatgttcaccagcaagtttaaggcgcgggtgatggtggctaggaaggtggtagatcagaatgataggagcaaggatgagttaaaatatgagtggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtaaccaagctggtgatgcctggggtctacacctacgaggccttccacccggacgttgtgctgctgccgggctgcggggtggacttcaccgagagccgcctgagcaacctcctgggcattcgcaagaagcaacctttccaagagggcttcaggatcatgtatgaggatctcgagggtggtaacatccccgccctcctggatgtcaagcaatatttggatagtaaaaagaagcttgaggaggcaacacagaatgcaaccagggctgctggagatatcagaggagacagtcatattccaagagctgtggaacaagcggctgaaaaggatctggtcattgtaccagtaacacaagatgaaagtaagagaagctataatgtcatagatggcacccatgacaccctctaccgaagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggttggcgccgagctcatgcccttccgcgccaagagcttttacaacgacctcgccgtctactcccagctcatccgcagctacacctccctcacccacgtcttcaaccgcttccccgacaaccagatcctctgccgtccgcccgcgcccaccatcaccacggtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaa

SEQ ID NO: 183 - DNA, 1512 bp, Adenovirus D25
  MISC_FEATURE (1)..(1512): Penton Gene
atggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagacgattctgcacaccaacatgcccaatgtgaacgagtacatgttcaccagcaagtttaaggcgcgggtgatggtggctagaaagcacccagagaatgtagacaaaacagatttgagtcaggataagcttgaatatgaatggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtgaccaagctggtgatgccaggggtctacacctacgaggcctttcacccggacgtggtgctgctgccgggctgcggggtggacttcacagagagccgcctgagcaacctcctgggcattcgcaagaagcaacctttccaagagggcttcagaatcatgtatgaggatctagaagggggtaacatccccgctctcctggataccaaaaaatatctggatagcaagaaggaacttgaggatgctgccaaggaagctgcaaagcaacagggagatggtgctgtcactagaggcgatacccacctcactgtagctcaagaaaaagcagctgaaaaggagctagtgatcgtaccaattgaaaaggatgagagcaacagaagttacaacctgatcaaggacacccatgacaccatgtaccgaagctggtacctgtcctatacctacggggaccccgagaagggggtgcagtcgtggacgctgctcaccactccggacgtcacctgcggcgcggagcaagtctactggtcgctgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccactatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgtgtgctttccagtcgcaccttctaa

SEQ ID NO: 184 - DNA, 1560 bp, Adenovirus D26
  MISC_FEATURE (1)..(1560): Penton Gene
atgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagcggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaa

SEQ ID NO: 185 - DNA, 1545 bp, Adenovirus D27
  MISC_FEATURE (1)..(1545): Penton Gene
atgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcaccccagccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctaggaaggtggtagatcagaatgataggagcaaggatgagttaaaatatgagtggtttgagtttaccctgcccgagggcaacttttccgagaccatgaccatagacctgatgaacaacgccatcttggaaaactacttacaagtggggcgacagaatggcgtgctggagagcgatatcggagtcaagtttgacagtaggaatttcaagctgggctgggacccggtgaccaagctggtgatgccaggggtctacacctacgaggcctttcacccggacgtggtgctgctgcctggctgcggggtggacttcaccgagagccgcctgagcaaccttctgggcattcgcaagaagcaacctttccaagagggcttcaggatcatgtatgaggatctcgagggtggtaacatccccgccctcctggatgtcaagcaatatttggatagtaaaaagaagcttgaggaggcaacacaaaatgcaaccagggctgctggagatatcagaggagacagtcatattccaagagctgtggaacaagcggctgaaaaggatctggtcattgtaccagtaacacaagatgaaagcaaaagaagctataatgtcatagatggcacccatgacaccctgtaccgaagttggtacctgtcctatacctacggggaccccgagaagggggtgcagtcgtggacgctgctcaccaccccggacgttacctgcggcgcggagcaagtctactggtcgctgccggacctcatgcaagaccccgtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccctgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaa

SEQ ID NO: 186 - DNA, 1554 bp, Adenovirus D33
  MISC_FEATURE (1)..(1554): Penton Gene
atgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtatttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctagaaagcatcccaaagatgtagatgcaagtgatttaagcaaggatatcttagagtatgattggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggcggtaacatccccgctctcctggataccaaaaaatatctggatagcaagaaagaaattgaagatgcaaaacagaaagcggcccaggcaggtggcgagatcagaggagacagtgctgatactagagctgcagaacaggcgactgaaaaagagctggttattgaacccatcgagcaagatgaaagcaagagaagctataatgtgatcaagggtacccatgacaccctgtaccgaagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgttctacccagcaagtcagcaactaccccgtggtcggcgccgagctcatgcccttccgcgccaagagcttttacaacgacctcgccgtctactcccagctcatccgcagctatacctccctcacctacgtcttcaaccgcttccccgacaaccagatcctatgccgcccgcccgcgcccaccatcaccaccgtcagtgaaaacgtgcctgctctcacagatcacgggacgcttccgctgcgcagcagtatccgcggagtccagcgagtgaccgtcactgacgcccgtcgccgcacctgtccctacgtctacaaggccctgggcatagtcgcgccgcgcgtgctctccagtcgcaccttctaa

SEQ ID NO: 187 - DNA, 1560 bp, Adenovirus D37
  MISC_FEATURE (1)..(1560): Penton Gene
atgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtatttggtggacaacaagtcggcggacatcgcttccctgaactaccaaaacgaccacagcaacttcctgaccacggtggtgcagaacaacgatttcacccctgccgaggccagcacgcagacgataaattttgacgagcggtcgcggtggggcggtgatctgaagaccattctgcacaccaacatgcctaatgtgaacgagtacatgttcaccagcaagtttaaggcgcgggtgatggtggctagaaaaaaggcggaaggggctgatgcaaatgataggagcaaggatatcttagagtatcagtggtttgagtttaccctgcccgagggcaacttttccgagaccatgaccatagacctaatgaacaacgccatcttggaaaactacttgcaagtggggcggcaaaatggcgtgctggagagtgatatcggagtcaagtttgacagcagaaatttcaagctgggctgggacccggtgaccaagctggtgatgccaggggtctacacctacgaggccttccacccggacgtggtgctgctgccgggctgcggggtggatttcaccgagagccgcctgagcaacctcctgggcattcgcaagaagcaaccttttcaagagggcttcagaatcatgtatgaggacctagtagggggcaacatccccgctctcctgaatgtcaaggagtatctgaaggataaggaagaagctggcaaagcagatgcaaatactattaaggctcagaatgatgccgtcccaagaggagataactatgcatcagcggcagaagccaaagcagcaggaaaagaaattgagttgaaggccattttgaaagatgattcagacagaagctacaatgtgatcgagggaaccacagacaccctgtaccgcagttggtacctgtcctatacctacggggatcccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctttgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaa

SEQ ID NO: 188 - DNA, 1560 bp, Adenovirus D69
  MISC_FEATURE (1)..(1560): Penton Gene
atgaggcgtgcggtggtgtcttcctctcctcctccctcgtacgagagcgtgatggcgcaggcgaccctggaggttccgtttgtgcctccgcggtatatggctcctacggagggcagaaacagcattcgttactcagagctggctccgctgtacgacaccactcgcgtgtacttggtggacaacaagtcggcggacatcgcttccctgaactaccaaaacgaccacagcaacttcctgaccacggtggtgcagaacaacgatttcacccccgccgaggccagcacacaaacaataaattttgacgagcggtcgcggtggggcggtgatctgaagaccattctgcacaccaacatgcccaatgtgaacgagtacatgtttaccagcaagtttaaggcgcgggtgatggtggctagaaaaaaggcggaaggggctgatgcaaatgataggagcaaggatatcttagagtaccagtggtttgagtttaccctgcccgagggcaacttttccgagaccatgaccatagacctgatgaacaacgccatcttggaaaactacttgcaagtggggcggcaaaatggcgtgctggagagcgatattggagtcaagtttgacagcaggaatttcaagctgggctgggacccggtgaccaagctggtgatgccaggggtttacacctatgaggccttccacccggacgtggtgctgctgcctggctgcggggtggacttcaccgagagccgcctgagcaacctcctgggcattcgcaagaagcaacctttccaagagggcttcagaatcatgtatgaggatctagtagggggcaacatccccgccctcctgaatgtcaaggagtatctgaaggataaggaagaagctggcacagcagatgcaaataccattaaggctcagaatgatgcagtcccaagaggagataactatgcatcagcggcagaagccaaagcagcaggaaaagaaattgagttgaaggccattttgaaagatgattcaaacagaagctacaatgtgatcgagggaaccacagacaccctgtaccgcagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggttggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgcttccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaa

SEQ ID NO: 189 - DNA, 2763 bp, Adenovirus A12
  MISC_FEATURE (1)..(2763): Hexon Gene
atgatggccactccctcgatgatgccgcagtggtcttacatgcacatcgccggtcaggatgcctcggagtacctgagtcccggtctggtgcaattcgcccgcgccacggacacctacttcaccctgggaaacaagtttagaaaccccaccgtggctcccacccatgatgttaccaccgatcgctcgcagcgtctgacgctgcgttttgtgcccgtggatcgggaagatactacctactcctacaaggctcgctttacgctggctgtgggtgacaaccgcgtgttagacatggctagttcttactttgacattcgaggggtactggatcgtggtcccagttttaagccctattccggaaccgcctacaattctttggcaccaaaaggcgctcctaatgcttcacaatggtcagataacgctaagcttaatacctttgctcaggcgccgtatcttagcgacactatcaccgccgccgatggtattaaagttggaacagacaccgcccaggcaggcgcggcggtgtatgccaacaaaacttatcagccagagccgcaagtaggaccaagtgaatggaacaccagcattgaaaacgttaaagctggcgggagggcattaaagcaaaccactgcaatgcagccgtgctatggctcctacgctcgtccaaccaacgaacacggaggacaatccaaggatgacaacattgaacttaagttctttgattcagctaacaatgcagcaaacactgctcaagttgtgttctataccgaagacgtaaaccttgaaatgccagacacgcatcttgtgtttaagcctactgttaccaatggaacaattgcttctgagtcgctgttgggacagcaagcagcgccaaatagagcaaactacattgcattcagagataattttattggcctgatgtattacaacagtacaggcaacatgggtgtattggccgggcaagcttcccaacttaacgcagtagtagacctgcaagacagaaatacagagctgtcataccagttaatgctggatgctttgggagacagaacacggtacttttccttgtggaattccgcagtggacagttacgaccctgacgttcgcgttattgagaatcacggggtagaggatgaactaccaaattattgctttcctcttagcgcagtaggtgaaataaaaaattacaaaggcattaagccagataacggaggaggaggtggctggactgccgacaacactgtcagtgaagcaaaccacataggcattgggaatatagccgccatggaaattaatttgcaggctaatttgtggagaagcttcttgtactcaaatgtgggcttatacctaccagacgacttaaaatacactccaggaaacataaaactacctgataacaagaacacctacgagtacatgaacgggcgtgtgactgccccggggttggtggatacctatgtcaatatcggcgctcgctggtccccagatgtgatggataatgtaaacccttttaaccaccaccgaaacgcagggttgcgctacagatccatgttgctaggcaatgggagatttgttccttttcacattcaggtgccgcaaaaattttttgccatcagaaatttgttgctgttgcccggttcctacacttacgaatggaactttagaaaggatgtaaacatgattcttcagagcacactgggaaatgatcttcgggtggacggagccagcgttcgctttgacaacattgccctgtatgctaacttttttcccatggcacataacacagcttctactttagaagccatgttaagaaatgacaccaacgaccagtcttttaacgattatttgtgtgctgcaaacatgctgtatcccatcccagctaacgccaccagcgtgcccatttcaataccttcgcgaaattgggcggcatttagaggctggagctttactcgcctaaaaactaaagaaactccttccctgggttcagggtttgacccctactttgtatactctggaaccattccctatttagacggcaccttttacctaaaccacacttttaagaaggtgtcaatcatgtttgactcctccgtgagttggcctggaaatgaccgtttgctaaccccaaatgaatttgaaataaagcgttctgtggatggggagggatacaatgtggcccaatgcaatatgactaaggattggttcctaatacaaatgcttagtcattacaacattggataccaaggtttttacattccagagagctacaaggaccgcatgtattctttctttagaaactttcagcccatgagtaggcaagttgtggataccacagaatataagaactacaaaaaagtaaccgtagagtttcaacataacaactcaggattcgtgggatacctgggccccactatgcgggagggacaagcttaccccgccaactatccctaccctcttataggcaaaacagctgtggaaagcatcacacagaaaaagtttctatgcgatcgtgttatgtggcgcatcccattttctagtaacttcatgtctatgggggcgctaacggatcttgggcaaaatatgctgtacgcaaactcagcccatgctctagacatgacatttgaggtggatccaatggatgagcctacccttctttatgttttatttgaagttttcgacgtggtacgcattcaccagccacaccgcggcgtcattgaagcggtctacctgcgcacgcccttctcggcgggtaacgctaccacctaa

SEQ ID NO: 190 - DNA, 2760 bp, Adenovirus A18
  MISC_FEATURE (1)..(2760): Hexon Gene
atggccactccgtcgatgatgccgcagtggtcttacatgcatatcgccggtcaggatgcctcggaatacctgagtcccgggctggtgcaattcgcccgtgccacggacacctacttcaccctgggcaacaagtttagaaatcccactgtagctcccactcatgacgttaccaccgatcgttctcagcggctgacactgcgttttgtgcccgtggatcgggaagatactgcttactcatacaaggctcgttttacgctagctgtgggtgataaccgcgtacttgatatggctagttcctactttgacattagaggggtactagaccgcggtcccagtttcaagccgtattctggaacggcttacaactctttggctccaaagggcgcgcccaatgctagccagtggctgactactaatgacaacaagtcccacacttttgctcaagcgccttacatagggagctccatcactaaagatggcattcaagtgggaacaaataccgccaatcccccacaaccagtatatgccgacaagacatatcaacccgaacctcaagtaggcgagagtcaatggaacgcgcctttgcctaacaacgcaaaagcagcaggaagggtgctcaagaacaccacacccatgtacccctgctatgggtcttacgcccgagccacaaatgaaaacggaggacaatcaaaaaataacgaaggggtggaaatgcaattttttgcatccgctgctgacaatcaaaatgatcccagtgttgtgctgtacagtgaggacgtaaacctggaagcccctgacacgcacattgtttttaagccagctgtagcagcagacactgttagttcggaactgctactaggtcaacaagcagcgcctaacagacccaattacattggcttcagagataacttcataggactaatgtactacaacagcactggaaatatgggagtgcttgccggacaggcttcgcagcttaatgcagtggtggacctgcaggacaggaatacagagctgtcctaccaacttatgctagacgctttaggcgaccgcagtcggtatttttctatgtggaactcagccgtggacagctacgatcctgatgtgcgaattattgaaaatcatggggtggaagacgaacttcccaattactgctttccactaggcgctgtggggattgtgaattcctacaaaggtgttaaatacgatgcaaatgcctgggcaaaggataacaacaaagcagataataataacttagcaacaggtaacatcttcgccatggaaataaacttgcaggctaatctgtggcgaagtttcttgtactcaaatgtgggcttgtacttacctgacagcttaaaatacactccgggaaacataaagctgcctgataataaaaacacctacgagtacatgaatggccgtgttacagccccggggttggtggatacttatgttaacatcggagctcgttggtcgccagatgttatggataacataaatccttttaaccaccaccgaaacgcagggctccgatacagatctatgctactaggcaatggcaggtttgtgccttttcacattcaggtgccgcagaaattttttgccataagaaacttgctgcttttacctggttcgtacacgtacgaatggaactttagaaaagatgtaaatatgatacttcaaagcaccctaggcaatgacctgcgggtggatggggcaagcattcgctttgacaacatcgcgctgtacgccaactttttccctatggctcataatacggcgtccaccctagaagctatgttgagaaatgacaccaacgaccagtcatttaatgactacctatgcgctgcaaacatgctgtaccctatcccagccaacgcaaccagtgtgccgatttctataccttccagaaattgggcagcatttaggggatggagttttactcgcttaaaaactaaggaaacaccgtcactgggctctggctttgacccgtactttgtgtactcgggaaccattccctatttggacggtacattttatcttaatcatactttcaaaaaggtgtcaattatgtttgactcctctgttagctggccgggaaacgaccgtttgcttacgcccaacgagtttgaaattaagcgttctgtggatggggaagggtacaacgtggctcaatgcaacatgactaaagactggtttcttatccagatgcttagtcactacaacattgggtaccagggtttctatgtgccagaaggctacaaagaccgaatgtattctttcttcagaaactttcagcctatgagtagacaggttgttgacactactgagtacaaagactacaaacaagtaacagtgaagtttcaacataacaattcagggttcgtgggctacttgggtcccaccatgcgggaaggtcaagcttatccagctaactatccctatcccctaattggaaagaccgctgtggaaagcataacgcagaaaaagtttttgtgcgatcgcgtaatgtggcgcatcccattttccagcaattttatgtctatgggagcgcttaccgaccttggacaaaacatgctgtatgcaaattccgcccatgctttggacatgacatttgaggtggatccaatggacgagcccacccttctttatgttttgtttgaagttttcgacgtggtgcggattcatcagccgcaccgcggcgtcatcgaagcggtatacctacgcacgcctttctctgcgggtaacgctaccacctaa

SEQ ID NO: 191 - DNA, 2754 bp, Adenovirus A31
  MISC_FEATURE (1)..(2754): Hexon Gene
atgatgccgcagtggtcttacatgcacatcgccggtcaggacgcctcggagtacctgagtcccggtctggtgcaattcgcccgcgccacggacacctacttcaccctgggaaacaagtttaggaatcccactgtggctcccacccatgatgtcaccaccgaccgctcgcagcggttgacgctgcgttttgtgcccgtggatcgggaagatactgcttattcttacaaggctcgctttacgctggctgtgggggacaatcgcgtgcttgacatggctagctcttactttgatattagaggggtgctggatcgcggtcccagttttaagccttattcgggtaccgcctataactctttagctccaaagggcgcgcccaatgccagccaatggctaactacaaacaatggcaacaaaactcacacttttgctcaagcgccttacataggagactctatcagtaaagacggcattcaagttgggacaaacactgccaatccccagcaagcagtatatgccgacaaaacataccagccagaacctcaagtaggcgaaagtcaatggaacgcttcagtatctaacaatgcaaaagcagcaggaagggtgttaaaaagcactacgcccatgtatccgtgctatgggtcttatgcacgagcaacaaatgaaaaaggaggtcaatcaaaaaataacgacggtgtggaaatgcgattttttgcatccagtgcgaatgacaatcaaaatgatccaactgttgtaatgtatagcgaggacgtaaacttagaggctcctgacacacacattgtttacaaaccagctgtaactgcggacactatcagttcagaactcctcctaggacaacaagcagcacctaacagaccaaattacattgccttcagagacaattttattgggcttatgtattacaacagcactggaaacatgggagtacttgcaggacaggcttctcagctcaatgcagtggttgatctgcaagataggaacacagagctgtcctaccaacttatgttggatgctttaggcgatagaagccgttatttttccatgtggaattctgccgtcgacagctacgatccagacgtgcgaattattgaaaatcatggtgtggaagacgaactgcccaattactgttttccgttaggggctgtaggcgttgtgaattcatacaaaggtgtgaaacaaaatgacggaaatggttgggtaaaagatgacagtgtagcagataccaatgacatagccaaaggtaatatatttgccatggaaattaacttacaggcaaatttgtggagaagttttctgtattcaaatgtggggctgtacctgcctgacgacttgaaatacacccccgggaacataaaacttccagaaaacaaaaacacctacgagtacatgaacgggcgcgtgactgttcccggtctggtagacacctacgttaacattggcgcgcgctggtctcctgacgtaatggataacataaacccttttaaccaccaccgaaacgcagggttgcgctataggtccatgttactgggcaacggtagatttgttccgtttcacattcaggtacctcagaaatttttcgctattaagaatttgctgctgttaccagggtcctacacttacgagtggaacttcagaaaagatgtaaacatgatacttcagagcaccctgggcaatgatcttagagtggacggagccagcattcgctttgacaacattgccctgtatgcaaacttcttccccatggctcacaatacagcttctacattggaagccatgctgcgaaatgacaccaatgaccagtctttcaacgattacttgtgcgcggcgaacatgttgtatcccattccagcaaatgccaccagcgtgcccatttcaataccttcgcgaaattgggcagccttcagagggtggagttttactcgccttaaaactaaagagacaccttctcttggttcagggtttgacccctactttgtttactctggaaccattccctacctggacgggactttttacctgaaccacacttttaaaaaggtgtcaatcatgtttgactcctctgttagctggcctggaaatgacaggctgttaacaccaaatgaatttgaaataaaacgttctgtagacggggaaggctacaatgtggcccaatgtaatatgaccaaagattggtttctagtacaaatgctcagtcattataatattggataccagggtttttacgttccagagagctacaaagaccgcatgtattctttcttcagaaactttcagcccatgagcaggcaggttgtagacactactgaatacaaggagtataaaaaagtaaccgtggaattccagcataacaactcagggtttgtgggatacctgggtcctactatgcgcgagggacaagcttatcccgcaaactacccctatcctctcataggaaaaaccgctgtacagagcgtcacacaaaaaaagtttctctgtgaccgtgtgatgtggcgcattccattttctagcaattttatgtcaatgggggcgttgacagacctcgggcaaaatatgctgtatgcaaattcggcccatgcgttagatatgacatttgaagttgaccccatggaagagcccacccttctttatgttttgtttgaagttttcgacgtggtgcgcattcatcaaccacaccgcggagtcattgaagcggtctatctgcgcacacccttctccgcgggtaacgccaccacctaa

SEQ ID NO: 192 - DNA, 2835 bp, Adenovirus B3
  MISC_FEATURE (1)..(2835): Hexon Gene
atggccaccccatcgatgatgccccaatgggcatacatgcacatcgccggacaggatgcttcggagtacctcagtccgggtctggtgcagttcgcccgtgcaacagacacctacttcagtatggggaacaaatttagaaaccccacagtggcgcccacccacgatgtgaccaccgaccgtagccagcgcctgatgctgcgcttcgtgcccgttgaccgggaagacaatacctactcttacaaagttcgctacacgctggctgtaggcgacaacagagtgcttgacatggccagcacattctttgacattcggggggtgcttgatagaggtcctagcttcaagccatattccggcacagcttacaattcactcgctcctaagggcgcgcccaatacatctcagtggatagttacaacaaatggggacaatgcagtaactaccaccacaaacacatttggcattgcttccatgaagggagacaatattactaaagaaggtttgcaaattgggaaagacattaccactactgaaggagaagaaaagcccatttatgccgataaaacatatcagccagagcctcaagttggagaagaatcatggactgatactgatggaacaaatgaaaagtttggtggaagagcccttaaaccagctaccaacatgaagccatgctacgggtcttttgcaagacctacaaacataaaagggggccaagctaaaaacagaaaagtaaaaccaacaaccgaaggaggggttgaaactgaggaaccagatattgatatggaatttttcgatggtagagatgctgttgcaggagctttagcgcctgaaattgtgctttatacggaaaatgtaaatttggaaactccagacagtcatgtggtatataaaccagaaacgtctaataactctcatgcaaatttgggtcaacaagccatgcctaacagacccaattacattggcttcagggataacttcgtaggcctaatgtactacaacagtactggaaatatgggagttttggctggccaagcatcacaactgaatgcagtggttgacttgcaggacagaaatactgaactgtcatatcagcttttgcttgattctctgggagacagaaccagatacttcagcatgtggaatcaggctgtggacagttacgatcccgatgttcgcattattgaaaatcatggcatcgaggatgaactgcctaattactgttttcctctgaatggcataggaccagggcacacatatcaaggcattaaagttaaaaccgatgacactaatggatgggaaaaagatgctaatgttgctccagctaatgaaataaccataggcaacaacctggctatggaaattaatatccaagctaacctttggagaagttttctgtactctaatgtggctttgtaccttccagatgtttacaagtacacgccacctaacattactttgcccactaacaccaacacctatgagtacatgaacgggcgagtggtatccccatccctggttgattcatacatcaacattggcgccaggtggtctcttgacccaatggacaatgtgaatccattcaaccaccaccgcaatgctggtctgcgctacaggtccatgcttctgggaaatggtcgttatgtgcctttccacatacaagtgcctcagaaattctttgctgtcaagaacctacttcttctacctggctcctacacctacgagtggaacttccgaaaggatgtgaacatggtcctgcaaagttcccttggaaatgacctcagaacggatggtgctaccataagtttcaccagcatcaatctctatgccaccttcttccccatggctcacaacacagcttccacccttgaagccatgctgcgcaacgataccaatgatcagtcatttaacgactacctctctgcagctaacatgctttaccccattcctgccaatgcaaccaacattccaatttccatcccatctcgcaactgggcagccttcaggggctggtccttcaccagactcaaaaccaaggagactccatctcttggatcagggttcgatccctacttcgtatattctggatctattccctacctggatggcaccttttaccttaaccacactttcaagaaggtctccatcatgtttgactcctcagtcagctggcctggcaatgacaggctgttgagtccaaatgagtttgaaatcaagcgcactgtggacggggaaggatacaacgtggcacaatgcaacatgaccaaagactggttcctggttcagatgcttgccaattacaacattggctaccagggcttttacatccctgagggatacaaggatcgcatgtactcctttttcagaaacttccagcctatgagcaggcaggtggttgatgaggttaattacactgactacaaagccgtcaccttaccataccaacacaacaactctggctttgtagggtaccttgcacctactatgagacaaggggaaccttacccagccaattatccatacccgctcatcggaactactgccgttaagagtgtcacccagaaaaagttcctgtgcgacaggaccatgtggcgcattcccttctccagcaacttcatgtccatgggggcccttaccgacctgggacagaacatgctctatgccaactcagcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataa

SEQ ID NO: 193 - DNA, 2814 bp, Adenovirus B7
  MISC_FEATURE (1)..(2814): Hexon Gene
atggccaccccatcgatgatgccccaatgggcatacatgcacatcgccggacaggatgcttcggagtacctgagtccgggtctggtgcagttcgcccgtgcaacagacacctacttcagtatggggaacaaatttagaaaccccacagtggcgcccacccacgatgtgaccaccgaccgtagccagcgactgatgctgcgcttcgtacccgttgaccgggaagacaatacctactcttacaaagttcgctacacgctggctgtaggcgacaacagagtgcttgacatggccagcacattctttgacattcggggggtgcttgatagaggtcctagctttaagccatattctggcacagcttacaattcactggctcctaagggcgcgcccaatacatctcagtggatagttacagcaggagaagaaagagcagtaactaccaccacaaacacatttggcattgcttccatgaagggagacaatattactaaagaaggtttagaaattgggaaagacattactgcagacaacaagcccatttatgccgataaaacatatcagccagagcctcaagttggagaagaatcatggactgatactgatggaacaaatgaaaagtttggaggtagagctcttaaaccagctaccaaaatgaagccatgctacgggtcttttgcaagacctacaaatataaaagggggccaagctaaaaacagaaaagtaaaaccaaccgaaggagatgttgagactgaggagccagatattgatatggaattttttgatggtagagaagctgctgacgctttttcgcctgaaattgtgctttacacggaaaatgtcaatttagaaactccagacagccatgtagtttacaagccaggaacttctgatgataactctcatgcaaatttgggtcaacaagccatgcctaacagacccaattacattggcttcagggataactttgtaggcctaatgtactacaacagtactggaaatatgggagttttggctggccaagcatcacaactgaatgcagtggttgacttgcaggacagaaacactgaactgtcatatcagcttttgcttgattctctgggagacagaaccagatacttcagtatgtggaaccaggctgtggacagttatgatcccgatgttcgcattattgaaaatcacggcatcgaggatgaactgcctaattactgttttcctctggatggcataggaccagcgaaaacatatcaaggcattaaatctaaagacaatggatgggaaaaagatgataatgtttctaaatctaatgaaatagccataggcaacaaccaggctatggaaattaatatccaagctaacctttggagaagttttctgtactccaatgtggctttgtaccttccagatgtttacaagtacacgccaactaacattactctgcccgccaacaccaacacctatgagtacatgaacgggcgagtggtatccccatctctggttgattcatacatcaacattggcgccaggtggtctcttgacccaatggacaatgtgaatccattcaaccaccaccgcaatgctggtctgcgctaccggtccatgcttctgggcaatggtcgttatgtgcctttccacatacaagtgcctcaaaaattctttgctgtcaagaacctacttcttctacctggctcctacacctatgagtggaacttcagaaaggatgtgaacatggtcctgcaaagttcccttggaaatgacctcagaacagatggtgctaccataagtttcaccagcatcaatctgtatgccaccttcttccccatggctcacaacacagcttccacccttgaagccatgctgcgcaacgataccaatgatcagtcattcaacgactacctctctgcagctaacatgctttaccccatccctgccaatgcaaccaacattccaatttccatcccatctcgcaactgggcagccttcaggggctggtccttcactaggctcaaaaccaaggagactccatctcttggatcagggttcgatccctacttcgtatattctggatctattccctacctggatggcaccttttaccttaaccacactttcaagaaggtctccatcatgtttgactcctcagtcagctggcctggcaatgacaggctgttgagcccaaatgagtttgaaatcaagcgcactgtggacggggaagggtacaatgtggcccaatgtaacatgaccaaagactggttcctggttcagatgcttgccaactacaacattggctaccagggcttttacatccctgagggatacaaggatcgcatgtactcctttttcagaaacttccagcctatgagcaggcaggtggttgatgaggttaattacactgactacaaagccgtcaccttaccataccaacacaacaactctggctttgtagggtatcttgcacctactatgagacaaggggaaccttacccagccaattatccatacccgctcatcggaactactgccgttaagagtgtcacccagaaaaagttcctgtgtgacaggaccatgtggcgcattcccttctccagcaacttcatgtccatgggggcccttaccgacctgggacagaacatgctctatgccaactcagcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataa

SEQ ID NO: 194 - DNA, 2823 bp, Adenovirus B16
  MISC_FEATURE (1)..(2823): Hexon Gene
atggccaccccatcgatgatgccccaatgggcatacatgcacatcgccggacaggatgcttcggagtacctgagtccgggtctggtgcagttcgcccgtgcaacagacacctacttcagtatggggaacaagtttagaaaccccacagtggcgcccacccacgatgtgaccaccgaccgtagccagcgactaatgctgcgcttcgtgcccgttgaccgggaagacaatacctactcttacaaagttcgctacacgctggctgtaggggacaacagagtactggatatggccagcacgttctttgacatccgcggcgtgctggaccggggccctagcttcaaaccctactccgggaccgcctacaacagcctggctcccaagggagcgcccaacacctgccagtggaaggattctgacagcaaaatgcatacctttggggtagctgccatgcccggtgttactgggaaaaagatagaagctgatgggctgcctattggaatagattcaacttctggaactgacacagtaatttatgctgataaaactttccaaccagaaccacaagttggaaatgccagttgggttgacgccaatggtacagaggaaaaatatggaggcagagctctgaaggacactacaaagatgaaaccctgctatggttctttcgccaagcctaccaacaaagaaggtggtcaggctaacttaaaagattcagaaaccgccgccaccactcctaactatgatatagatctggctttctttgacaacaaaaatattgctgctaactacgatccagatattgtaatgtacacagaaaatgttgacttgcagactccagatactcatattgtatacaaacctggaacagaggacaccagctctgaatccaatttgggtcagcaagccatgcctaacagacccaactacattggcttcagagacaattttattgggctcatgtactacaacagcactggcaatatgggggtgctggccggtcaggcctctcagctgaatgctgtggttgacttgcaagacagaaacactgaactgtcctaccagctcttgcttgactctctgggtgacagaacccggtatttcagtatgtggaatcaggcggtggacagctatgatcctgatgtgcgtattattgaaaaccatggtgtggaggacgaattgccaaactattgctttccgttgaatggtgtgggatttacagacacttaccaaggtgttaaagttaaaacagatgcagttgctggaaccagtggaacacagtgggacaaagatgacaccacagttagtactgctaatgaaatccatggaggcaatccttttgccatggaaatcaacatccaagccaatctatggcgaagtttcctttattccaatgtggctttgtatctcccagactcgtataaatacaccccgtccaatgtcactctcccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtaaacatggttctacagagttcccttggtaacgacctacgggtagatggcgccagcatcagtttcacgagcatcaatctttatgctacttttttccccatggctcacaacaccgcttccacccttgaagccatgctgcggaatgacaccaatgatcagtcattcaacgactacctatctgcagctaacatgctctaccccatacctgccaacgcaaccaatattcccatttccattccttctcgcaactgggcggctttcagaggctggtcatttaccagactgaaaaccaaagaaactccctctttggggtctggatttgacccatactttgtctattccggttctattccctacctggatggtaccttctatctaaatcacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacattggctaccagggcttttacatccctgagggatacaaggatcgcatgtactcctttttcagaaacttccagcctatgagcaggcaggtggttgatgaggttaattacactgactacaaagccgtcaccttaccatatcaacacaacaactctggctttgtaggataccttgcgcctactatgagacaaggggaaccttacccagccaattatccatacccgctcatcggaactactgccgttaagagtgttacccaaaaaaagttcctgtgcgacaggaccatgtggcgcataccgttctccagcaacttcatgtccatgggggcccttacagacctgggacaaaacctgctctatgccaactcggcccatgcactggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataa

SEQ ID NO: 195 - DNA, 2850 bp, Adenovirus B21
  MISC_FEATURE (1)..(2850): Hexon Gene
atggccaccccatcgatgctgccccagtgggcatacatgcacatcgccggacaggatgcttcggagtacctgagtccgggtctggtgcagttcgcccgcgccacagacacctacttcaatctggggaacaagtttaggaaccccaccgtggcgcccacccatgatgtgaccaccgaccgcagtcagcggctgatgctgcgctttgtgcccgttgaccgggaagacaatacctacgcatacaaagttcgatacaccttggctgtgggcgacaacagagtgctggatatggccagcactttctttgacattcggggtgtgttggatagaggccctagcttcaagccatactctggcactgcttacaactcgttggcccctaagggcgctcccaatacatctcagtggattgctgaaggcgtaaaaaaagaagatgggggatctgacgaagaggaagagaaaaatctcaccacttacacttttggaaatgccccagtgaaagcagaaggtggtgatatcactaaagacaaaggtcttccaattggttcagaaattacagacggcgaagccaaaccaatttatgcagataaactataccaaccagaacctcaggtgggagatgaaacttggactgacacagatggaacaactgagaagtatggtggtagagctctaaagccagaaactaaaatgaaaccctgctatgggtcttttgctaaacccactaacgtcaaaggcggacaggcaaaacaaaaaactactgaacaaccgcaaaaccagcaggttgaatatgatattgacatgaacttttttgatgaagcgtcacagaaagcaaacttcagtccaaaaattgtgatgtatgcagaaaatgtagacttggaaaccccagacactcatgtggtgtacaaacctggtacttcagaagaaagttctcatgctaatctgggtcaacaatctatgcccaacagacccaactacattggctttagagataactttattggacttatgtactacaacagtactggcaacatgggagtgctggcaggtcaagcatcccaattgaatgcggtggttgacttgcaggacagaaacacagaactatcatatcaactactgcttgactctctgggtgacagaaccagatacttcagcatgtggaatcaagcagtcgatagctatgatcctgatgtgcgcattattgaaaatcatggggtggaagatgagcttcccaactactgctttccattggatggagtaggggtaccaataagtagttacaaaataattgaaccaaacggacagggtgcagattggaaagagcctgacataaatggaacaagtgaaattggacaaggaaatctctttgccatggaaattaacctccaagctaatctctggagaagttttctttattccaatgtggctctgtatctcccagactcctacaaatacaccccagccaatgtcactcttccaactaacaccaacacttatgactacatgaatgggcgggtggttcccccatccctggtggatacctacgtaaacattggcgccagatggtctttggatgccatggacaatgtcaacccctttaaccatcaccgcaacgctggcctgcgataccggtccatgcttttgggcaatggtcgttacgtgcctttccacattcaagtgcctcagaaattctttgctgtgaagaacctgctgcttctacccggttcttacacctacgagtggaacttcagaaaggatgtgaacatggtcctgcagagttcccttggtaatgatctccgggtcgatggtgccagcataagttttaccagcatcaatctctatgccaccttcttccccatggcccacaacactgcctccacccttgaagccatgctgcgcaatgacaccaatgatcaatcattcaatgactacctttctgctgccaacatgctctaccccatcccggccaacgctaccaacgttcccatctccattccctctcgcaactgggccgccttcagaggctggtccttcaccagactcaaaaccaaggagactccctctttgggatcagggttcgatccctactttgtttactctggttctataccctacctggatggtaccttctaccttaaccacactttcaagaaagtctccatcatgtttgactcttcagtgagctggcctggtaatgacagattgctaagtccaaatgagttcgaaatcaagcgcacagttgatggggaaggctacaatgtggcccaatgtaacatgaccaaagactggttcctggtccagatgcttgccaactacaacattggataccagggcttctacgttcctgagggttacaaggatcgcatgtactccttcttcagaaacttccagcccatgagtagacaggtggttgatgagattaactacaaagactataaagctgtcgccgtaccctaccagcataataactctggctttgtgggttacatggctcctaccatgcgtcagggtcaagcgtaccctgctaactacccataccccctaattggaaccactgcagtaaccagtgtcacccagaaaaaattcctgtgcgacaggaccatgtggcgcatcccattctctagcaacttcatgtccatgggtgcccttacagacctgggacagaacttgctgtatgccaactcggcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataa

SEQ ID NO: 196 - DNA, 2787 bp, Adenovirus B50
  MISC_FEATURE (1)..(2787): Hexon Gene
atgcacatcgccggacaggatgcttcggagtacctgagtccgggtctggtgcagttcgcccgcgccacagacacctacttcaatctggggaacaagtttaggaaccccaccgtggcgcccacccatgatgtgaccaccgaccgcagtcagcggctgatgctgcgctttgtgcccgttgaccgggaagacaatacctacgcatacaaagttcgatacaccttggctgtgggcgacaacagagtgctggatatggccagcactttctttgacattcggggtgtgttggatagaggtcctagcttcaagccatattctggcactgcttacaactcattggcccctaagggcgctcccaatacatctcagtggcttaataagggagatgaagaggatggggaagacgaccaacaagctacatacacttttggcaatgcgccagtaaaagccgaagctgaaattacaaaagaaggactgccaataggtttggaagttccatctgaaggtggccctaaacccatttatgctgataaactgtatcagccagaacctcaggtgggagaggaatcttggactgatacggatggcacagatgaaaaatatggaggcagagcacttaaacctgaaactaaaatgaaaccctgctacgggtctttcgctaaacctactaatgttaaaggcgggcaggcaaaagtgaagaaagaagaagaaggcaaggttgaatatgacattgacatgaactttttcgacctaagatcacaaatgactggcctcaagcctaaaattgtaatgtatgcagaaaatgtggatctagaaactcctgacactcatgtggtgtacaaacctggagcttcagatgctagctctcatgcaaaccttggtcaacagtccatgcccaatagacctaactatattggcttcagggacaacttcatcggactcatgtactacaacagtactggcaacatgggagtgctggctggacaagcgtctcagctaaatgcagtggttgacttgcaagacagaaacacagaattgtcatatcaactcttgcttgattctctgggggacagaaccagatatttcagtatgtggaatcaagcagtggatagctatgacccagatgtgcgtgttattgagaaccatggtgtggaagatgaacttcctaactattgttttccattggatggtgtaggtccgcgaatagacagttacaagggaattgagacaaatggtgatgaaaccactacttggaaagatttagagccaaagggcataagtgaaattgctaagggaaatccgtttgccatggaaattaacctccaagctaatctctggagaagttttctttattccaatgtggctctgtatctcccagactcctacaaatacaccccagccaatgtcactcttccaactaacaccaacacttatgactacatgaatgggcgggtggttcccccatccctggtggatacctacgtaaacattggcgccagatggtctttggatgccatggacaatgtcaacccctttaaccatcaccgcaacgctggcctgcgataccggtccatgcttttgggcaatggtcgttacgtgcctttccacattcaagtgcctcagaaattctttgctgtgaagaacctgctgcttctacccggttcttacacctacgagtggaacttcagaaaggatgtgaacatggtcctgcagagttcccttggtaatgatctccgggtcgatggtgccagcataagttttaccagcatcaatctctatgccaccttcttccccatggcccacaacactgcctccacccttgaagccatgctgcgcaatgacaccaatgatcaatcattcaatgactacctttctgctgccaacatgctctaccccatcccggccaacgctaccaacgttcccatctccattccctctcgcaactgggccgccttcagaggctggtccttcaccagactcaaaaccaaggagactccctctttgggatcagggttcgatccctactttgtttactctggttctataccctacctggatggtaccttctaccttaaccacactttcaagaaagtctccatcatgtttgactcttcagtgagctggcctggtaatgacagattgctaagtccaaatgagttcgaaatcaagcgcacagttgatggggaaggctacaatgtggcccaatgtaacatgaccaaagactggttcctggtccagatgcttgccaactacaacattggataccagggcttctacgttcctgagggttacaaggatcgcatgtactccttcttcagaaacttccagcccatgagtagacaggtggttgatgagattaactacaaagactataaagctgtcgccgtaccctaccagcataataactctggctttgtgggttacatggctcctaccatgcgtcagggtcaagcgtaccctgctaactacccataccccctaattggaaccactgcagtaaccagtgtcacccagaaaaaattcctgtgcgacaggaccatgtggcgcatcccattctctagcaacttcatgtccatgggtgcccttacagacctgggacagaacttgctgtatgccaactcggcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataa

SEQ ID NO: 197 - DNA, 2847 bp, Adenovirus B11
  MISC_FEATURE (1)..(2847): Hexon Gene
atggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaa

SEQ ID NO: 198 - DNA, 2838 bp, Adenovirus B14a
  MISC_FEATURE (1)..(2838): Hexon Gene
atggccaccccatcgatgctgccccagtgggcatacatgcacatcgccggacaggatgcttcggagtacctgagtccgggtctggtgcagttcgcccgcgccacagacacctacttcaatctgggaaataagtttagaaatcccaccgtagcgccaacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagtttcaaaccctattctggtacggcttacaactctctggctcctaaaggcgctccaaatgcatctcagtggttggataaaggggttgaaactactgaagaacggcaaaatgaagacggggaaaatgacgaaaaagctacatacacttttggcaatgccccagtaaaagccgatgctgacattacaaaagacggactaccaataggtttggaagtcccagctgaaggtgaccctaaacctatctacgctaataagctttaccaaccagaaccccaggtgggacaggaatcgtggactgatacagatggcactgaagaaaaatacggaggcagagtacttaaaccggacactaaaatgaaaccgtgctatgggtcttttgctaaacctactaatgtgaaaggcggacaggcaaaagtgaaaacagaagaaggcaacaacattgaatatgacattgacatgaacttttttgacttaagatcacaaaaacaaggtcttaaacctaagattgtaatgtatgcagaaaatgtggacctggaatctccagatactcatgttgtgtacaaacctgaagtttcagatgctagttcaaatgctaatcttggacagcagtctatgcccaacagacccaactacattggcttcagagataattttattggtcttatgtactataacagtactggtaacatgggggtgctggctggccaagcatctcagttgaatgcagtggttgacttgcaggacagaaacacagaactgtcttaccaactcttgcttgactccctgggcgatagaaccagatactttagcatgtggaatcaggctgttgacagttatgatcccgatgtgcgtgttattgaaaatcatggtgtggaagatgaacttcccaactactgttttccactggacggcatcggtccgcgaacagatagttacaaggagattcagttaaatggagaccaagcttggaaagatgtaaatccaaatggtatcagtgaacttgttaagggaaatccatttgccatggaaattaaccttcaagccaatctatggcgaagtttcctttattccaatgtggctctgtatctcccagactcgtacaaatacaccccgtccaatgtcactcttccagaaaacaaaaacacctacgactacatgaacgggcgggtggtgccgccatctctagtagacacctatgtgaacattggcgccaggtggtctctggatgctatggacaatgtcaacccattcaaccaccaccgtaacgctggcttgcgttaccgatccatgcttttgggtaacggacgttatgtgcctttccacatacaagtgcctcaaaaattcttcgctgtcaaaaacctgctgcttctcccaggctcctacacttatgagtggaacttcaggaaggatgtgaacatggtgctacagagttccctcggtaacgacctacgggtagatggcgccagcatcagtttcacgagcatcaacctctatgctacctttttccccatggctcacaacaccgcttccacccttgaagccatgctgcggaatgacaccaatgatcagtcattcaacgactatctatctgcagctaacatgctctatcccattcctgccaatgcaaccaatattcccatttccattccttctcgcaactgggcggctttcagaggctggtcatttaccagactcaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcccaacgaatttgaaataaagcgcactgtggatggcgaaggctacaatgtagcccaatgcaacatgaccaaagactggttcttggtacagatgctcgccaactacaacataggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaacatgctttatgccaactcagctcatgctctggacatgacctttgaggtggatcccatggatgagcccaccctgctttatcttctcttcgaagttttcgacgtggtcagagtgcatcagccacatcgcggcatcatcgagacagtctacctgcgtacaccgttctcggccggtaacgctaccacgtaa

SEQ ID NO: 199 - DNA, 2838 bp, Adenovirus B14b; identical to SEQ ID NO: 198
  MISC_FEATURE (1)..(2838): Hexon Gene

SEQ ID NO: 200 - DNA, 2856 bp, Adenovirus B34
  MISC_FEATURE (1)..(2856): Hexon Gene
atggccaccccatcgatgctgccccaatgggcatacatgcacatcgccggacaggatgcttcggagtacctgagtccgggtctggtgcagttcgcccgcgccacagacacctacttcaatctgggaaataagtttagaaatcctaccgtagcgccgacccacgatgtgaccaccgatcgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagttttaaaccctattctggtacggcttacaactccctggctcctaaaggcgctccaaatgcatctcagtggttggataagggagttacaagcactggcctagtggacgacggcaatactgatgatggggaagaagccaaaaaagcaacatacacttttggtaatgctccagtaaaagccgaggctgaaatcacaaaagacggattgccggtgggcttggaagtttcaactgaaggtcctaaaccaatctatgctgataagctttatcagccagaacctcaagtgggagacgaaacttggactgacctagacggaaaaaccgaagagtatggagggagggttcttaaacctgaaactaaaatgaaaccctgctacggatcttttgctaaacctactaatattaaaggaggtcaggcaaaggtaaaaccaaaagaagacgatggcactaacaacatcgagtatgacattgacatgaacttctttgacttaagatcacaaagatcagaactcaaacctaaaattgtaatgtatgcagaaaatgtggacctggaatgtccagatactcatgttgtgtacaaacctggagtttcagatgctagttctgagaccaatcttggacaacagtctatgcccaacagacccaactacattggcttcagagataacttcatcggacttatgtactataacagtactggcaacatgggggtactggctggccaagcgtctcagttgaatgcagtggttgacttgcaggacagaaacacagaactgtcttaccaactcttgcttgactctctgggcgacagaaccagatactttagcatgtggaatcaggctgtggacagttatgatcctgatgtacgtgttattgaaaatcatggtgtggaagatgaacttcccaactattgttttccgttggatggtgtcggtccgcgaacagatagttacaaggagattaagccaaatggagaccaatctacttggacaaatgtagacccaactggcagcagtgaacttgctaagggaaatccatttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtaaacatggttctacagagttccctcggtaacgacctacgggtagatggcgccagcatcagttttacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctacttcgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgtcaaggtcaaccctatcccgctaactatccctatccactcattggaacaactgccgtaaatagtgttacgcagaaaaagttcttgtgtgacagaaccatgtggcgcataccgttctcaagcaacttcatgtctatgggagcccttacagacttgggacagaacatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaa

SEQ ID NO: 201 - DNA, 2859 bp, Adenovirus B35
  MISC_FEATURE (1)..(2859): Hexon Gene
atggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagtttcaaaccctattctggtacggcttacaactctctggctcctaaaggcgctccaaatgcatctcaatggattgcaaaaggcgtaccaactgcagcagccgcaggcaatggtgaagaagaacatgaaacagaggagaaaactgctacttacacttttgccaatgctcctgtaaaagccgaggctcaaattacaaaagagggcttaccaataggtttggagatttcagctgaaaacgaatctaaacccatctatgcagataaactttatcagccagaacctcaagtgggagatgaaacttggactgacctagacggaaaaaccgaagagtatggaggcagggctctaaagcctactactaacatgaaaccctgttacgggtcctatgcgaagcctactaatttaaaaggtggtcaggcaaaaccgaaaaactcggaaccgtcgagtgaaaaaattgaatatgatattgacatggaattttttgataactcatcgcaaagaacaaacttcagtcctaaaattgtcatgtatgcagaaaatgtaggtttggaaacgccagacactcatgtagtgtacaaacctggaacagaagacacaagttccgaagctaatttgggacaacagtctatgcccaacagacccaactacattggcttcagagataactttattggactcatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactattgttttccactggacggcataggtgttccaacaaccagttacaaatcaatagttccaaatggagaagataataataattggaaagaacctgaagtaaatggaacaagtgagatcggacagggtaatttgtttgccatggaaattaaccttcaagccaatctatggcgaagtttcctttattccaatgtggctctgtatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatctatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaa

SEQ ID NO: 202 - DNA, 2880 bp, Adenovirus C1
  MISC_FEATURE (1)..(2880): Hexon Gene
atgatgccgcagtggtcttacatgcacatctcgggccaggacgcctcggagtacctgagccccgggctggtgcagttcgcccgcgccaccgagacgtacttcagcctgaataacaagtttagaaaccccacggtggcgcctacgcacgacgtgaccacagaccggtctcagcgtttgacgctgcggtttatccccgtggaccgcgaggataccgcatactcgtacaaggcgcggtttaccctggctgtgggtgacaaccgtgtgcttgacatggcttccacatactttgacattcgcggcgtgctggaccggggccccacttttaagccctactccggcactgcctacaacgctctagcccccaaaggcgctcccaattcctgcgagtgggaacaagaagaaccaactcaggaaatggctgaagaacttgaagatgaggaggaggcagaggaggaggaggcagaggaggaggcagaagcaccacaagctgatcagaaggttaagaagactcatgtatatgctcaggctcctttggcaggggaaaaaattaccgccaatggcttacaaatagtttctgatacccaaactgaaggcaatccagtttttgccgatcccacttatcaacctgaacctcaggttggagaatctcagtggaatgaagctgaagcaactgcatctggaggcagagtactaaaaaagactactcccatgaaaccatgctacggatcgtatgccagacctacaaataaaaatgggggtcaaggtatactagtagcaaacaaccaaggtgctctagagtctaaagttgaaatgcagttttttgccccctctggcactgccatgaatgaaagaaatgctgttcagccaagtattgttttgtacagtgaggatgttaatatggaaactcctgatactcacatttcatacaaaccaagcaaaactgatgaaaactctaaggctatgttgggtcaacaagcaatgccaaacagacccaattacatcgcttttagggacaattttattggccttatgtattacaacagcactggtaacatgggtgtccttgctggacaagcatcacagctaaatgccgtggtagacttgcaggacagaaacacagagctgtcatatcaacttttgcttgattctattggcgatagaaccagatacttttccatgtggaatcaggctgtagacagctatgatccagatgtcagaatcattgaaaatcatggaactgaggatgagttgccaaattactgcttcccacttggcggtataggggtaactgacacctaccaaggtataaaatcaaacggaaacggtaatcctcaaaactggaccaaaaatgacgattttgcggcacgtaatgaaataggtgtgggaaacaactttgccctggagattaaccttaatgccaacctatggagaaatttcctctactccaacattgcactgtacctgcctgacaagctaaaatacactcctacaaatgtggaaatatctcccaaccctaattcatacgattatatgaacaagcgagtggtggctcccgggttggtggattgctacattaaccttggagcgcgttggtcattggactacatggacaacgtcaacccctttaaccatcaccgcaatgcgggcctacgctaccgctccatgttgctgggcaacggtcgctacgtgccctttcacatccaggttcctcagaagttttttgccattaagaacctcctactcttgccgggctcatacacctacgagtggaacttcaggaaagatgttaacatggtcctgcaaagctccctaggaaacgacctaagagttgacggagccagcattaagtttgacagcatttgcctctacgccaccttttttccgatggcccacaacaccgcctcaacgcttgaagccatgcttagaaacgacaccaacgaccagtcctttaacgactacctatccgccgccaacatgctttaccccatacccgccaacgccaccaacgtgcccatctctatcccctcgcgcaactgggcggctttccgaggctgggcctttacgcgccttaagactaaggaaaccccatccctgggttccggctacgacccttactatacctactctggctccataccctacctagacggaaccttttaccttaatcacaccttcaaaaaggtagccatcacctttgactcttctgttagctggcctggcaatgaccgtctgcttacccccaacgagtttgagatcaagcgttcagttgacggagagggctacaacgttgcccaatgcaacatgaccaaagactggttcttggtacagatgctagccaactacaacataggctaccagggcttttatatcccagaaagctataaggaccgcatgtactccttctttagaaacttccagcccatgagccgtcaggtggtggacgataccaaatacaaggactaccaacaggtgggcatcctccaccagcacaataactctggctttgttggttacctcgctcccaccatgcgagagggacaggcctaccccgccaacttcccctacccgcttataggcaagaccgcggttgacagtattacccagaaaaagtttctttgcgaccgcaccctttggcgcattccattctccagtaactttatgtccatgggtgcactcacagacctgggccaaaaccttctctatgcaaactccgcccacgcgctagatatgacttttgaggtggatcccatggacgagcccacccttctttatgttttgtttgaagtctttgacgtggtccgtgtgcaccagccgcaccgcggcgtcatcgagaccgtgtacctgcgcacgcccttctcggctggcaacgccacaacataa

SEQ ID NO: 203 - DNA, 2907 bp, Adenovirus C2
  MISC_FEATURE (1)..(2907): Hexon Gene
atggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcacctacgcacgacgtaaccacagaccggtcccagcgtttgacgctgcggttcatccctgtggaccgcgaggataccgcgtactcgtacaaagcgcggttcaccctggctgtgggtgacaaccgtgtgcttgatatggcttccacgtactttgacatccgcggcgtgctggacagggggcctacttttaagccctactccggcactgcctacaacgctctagctcccaagggcgctcctaactcctgtgagtgggaacaaaccgaagatagcggccgggcagttgccgaggatgaagaagaggaagatgaagatgaagaagaggaagaagaagagcaaaacgctcgagatcaggctactaagaaaacacatgtctatgcccaggctcctttgtctggagaaacaattacaaaaagcgggctacaaataggatcagacaatgcagaaacacaagctaaacctgtatacgcagatccttcctatcaaccagaacctcaaattggcgaatctcagtggaacgaagctgatgctaatgcggcaggagggagagtgcttaaaaaaacaactcccatgaaaccatgctatggatcttatgccaggcctacaaatccttttggtggtcaatccgttctggttccggatgaaaaaggggtgcctcttccaaaggttgacttgcaattcttctcaaatactacctctttgaacgaccggcaaggcaatgctactaaaccaaaagtggttttgtacagtgaagatgtaaatatggaaaccccagacacacatctgtcttacaaacctggaaaaggtgatgaaaattctaaagctatgttgggtcaacaatctatgccaaacagacccaattacattgctttcagggacaattttattggcctaatgtattataacagcactggcaacatgggtgttcttgctggtcaggcatcgcagctaaatgccgtggtagatttgcaagacagaaacacagagctgtcctatcaactcttgcttgattccataggtgatagaaccagatatttttctatgtggaatcaggctgtagacagctatgatccagatgttagaatcattgaaaaccatggaactgaggatgaattgccaaattattgttttcctcttgggggtattggggtaactgacacctatcaagctattaaggctaatggcaatggctcaggcgataatggagatactacatggacaaaagatgaaacttttgcaacacgtaatgaaataggagtgggtaacaactttgccatggaaattaacctaaatgccaacctatggagaaatttcctttactccaatattgcgctgtacctgccagacaagctaaaatacaaccccaccaatgtggaaatatctgacaaccccaacacctacgactacatgaacaagcgagtggtggctcccgggcttgtagactgctacattaaccttggggcgcgctggtctctggactacatggacaacgttaatccctttaaccaccaccgcaatgcgggcctccgttatcgctccatgttgttgggaaacggccgctacgtgccctttcacattcaggtgccccaaaagttttttgccattaaaaacctcctcctcctgccaggctcatatacatatgaatggaacttcaggaaggatgttaacatggttctgcagagctctctgggaaacgatcttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctataccccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacctttgactcttctgttagctggccgggcaacgaccgcctgcttactcccaatgagtttgagattaaacgctcagttgacggggagggctacaacgtagctcagtgcaacatgaccaaggactggttcctggtgcagatgttggccaactacaatattggctaccagggcttctacattccagaaagctacaaggaccgcatgtactcgttcttcagaaacttccagcccatgagccggcaagtggttgacgatactaaatacaaggagtatcagcaggttggaattcttcaccagcataacaactcaggattcgtaggctacctcgctcccaccatgcgcgagggacaggcttaccccgccaacgtgccctacccactaataggcaaaaccgcggttgacagtattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataa

SEQ ID NO: 204 - DNA, 2859 bp, Adenovirus C5
  MISC_FEATURE (1)..(2859): Hexon Gene
atggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataa

SEQ ID NO: 205 - DNA, 2892 bp, Adenovirus C6
  MISC_FEATURE (1)..(2892): Hexon Gene
atggctaccccttcgatgatgccgcagtggtcttacatgcacatctcgggccaggacgcctcggagtacctgagccccgggctggtgcagttcgcccgcgccaccgagacgtacttcagcctgaataacaagtttagaaaccccacggtggcgcctacgcacgacgtgaccacagaccggtctcagcgtttgacgctgcggttcatccccgtggaccgcgaggatactgcgtactcgtacaaggcgcggttcaccctagctgtgggtgataaccgtgtgctagacatggcttccacgtactttgacatccgcggcgtgctggacaggggccctacttttaagccctactctggcactgcctacaacgcactggcccccaagggtgcccccaactcgtgcgagtgggaacaaaatgaaactgcacaagtggatgctcaagaacttgacgaagaggagaatgaagccaatgaagctcaggcgcgagaacaggaacaagctaagaaaacccatgtatatgcccaggctccactgtccggaataaaaataactaaagaaggtctacaaataggaactgccgacgccacagtagcaggtgccggcaaagaaattttcgcagacaaaacttttcaacctgaaccacaagtaggagaatctcaatggaacgaagcggatgccacagcagctggtggaagggttcttaaaaagacaactcccatgaaaccctgctatggctcatacgctagacccaccaattccaacggcggacagggcgttatggttgaacaaaatggtaaattggaaagtcaagtcgaaatgcaatttttttccacatccacaaatgccacaaatgaagttaacaatatacaaccaacagttgtattgtacagcgaagatgtaaacatggaaactccagatactcatctttcttataaacctaaaatgggggataaaaatgccaaagtcatgcttggacaacaagcaatgccaaacagaccaaattacattgcttttagagacaattttattggtctcatgtattacaacagcacaggtaacatgggtgtccttgctggtcaggcatcgcagttgaacgctgttgtagatttgcaagacagaaacacagagctgtcctaccagcttttgcttgattcaattggcgacagaacaagatacttttcaatgtggaatcaagctgttgacagctatgatccagatgtcagaattattgagaaccatggaactgaggatgagttgccaaattattgctttcctcttggtggaattgggattactgacacttttcaagctgttaaaacaactgctgctaacggggaccaaggcaatactacctggcaaaaagattcaacatttgcagaacgcaatgaaataggggtgggaaataactttgccatggaaattaacctgaatgccaacctatggagaaatttcctttactccaatattgcgctgtacctgccagacaagctaaaatacaaccccaccaatgtggaaatatctgacaaccccaacacctacgactacatgaacaagcgagtggtggctcctgggcttgtagactgctacattaaccttggggcgcgctggtctctggactacatggacaacgttaatccctttaaccaccaccgcaatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataa

SEQ ID NO: 206 - DNA, 2859 bp, Adenovirus D8
  MISC_FEATURE (1)..(2859): Hexon Gene
atgtgccttaccgccagagaacgcgcgaagatggccaccccctcgatgatgccgcagtgggcgtacatgcacatcgccgggcaggacgcctcggagtacctgagcccgggtctggtgcagtttgcccgtgccaccgacacgtacttcagcctgggcaacaagtttagaaaccccacggtggctcccacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacgtactttgacatccgcggcgtcctggaccgcggtcccagcttcaaaccctactcgggcacggcttacaacagcctggctcccaagggcgcccccaatcccagtcagtgggaacaggcaaaaacaggagctggtgtagaccaaaatcaaaaagaaactcgcacttacggcgtagccgccactggcggatataacattacaaaagaaggacttcagattggaattgatgaaactaaagaagatccaaacaacaaaatttatgcagataaaacattccagccggaaccacaaataggggaaaataattggcaggacactaatgttttctatggcggcagagctcttaaaaaggaaaccaagatgaaaccatgctatggctcatttgccagaccaactaataaaaaaggagggcaggctaaagttttaaccactgaagatggtcaacctacagaaaactttgacatagacttggctttctttgatattccacaagctggtggaaatgacaatcttgatccagatatgattctgtatgccgaaaatgtaaatctagaaacacctgacacacatgtagtttataaaccaggcaaggatgatgcaagttctgccgctaacctcacacaacagtccatgccaaacagacccaactacatcggtttcagggacaactttgtgggacttatgtattacaacagcactggcaacatgggtgtgctggctggtcaggcctctcagttaaatgctgtggtcgacttgcaagacagaaataccgagctgtcttatcagcttttattagattctctgggtgacaggaccagatactttagtatgtggaactctgcggtggacagctatgatccagatgtcaggatcattgagaatcacggtgtggaggacgaacttccaaattattgcttcccattggatggtaccggtaccaatgccacataccaaggtgtggaaccagataatgctcaaggtcaaaatgataaatggaaaaaggacgagaaagtggctgctcaaaaccaaatttgcaagggcaatatttatgccatggagattaacctccaggccaacctgtggaagagttttctgtactcgaacgtggccttgtacctgcccgactccttcaagtacacgccggccaacgtcacgctgcccactaacaccaacacctacgagtacatgaacgggcgcgtggcggccccctcgctggtggacgcctacgtcaacattggcgcccgctggtcactggaccccatggacaacgttaacccctttaaccaccaccgcaatgcgggcctgcgctaccgctccatgctgctgggcaacgggcgctacgtgcccttccatattcaagtgccccaaaagttttttgccattaagaacctgcttctgctcccgggctcctacacctacgagtggaacttccgcaaggatgttaacatgattctgcagagttcccttggcaacgacctgcgcgtcgacggtgcctccgtccgcttcgacagtgttaacctttacgccacctttttccccatggcgcacaacaccgcctccaccctggaagccatgctgcgcaacgacaccaacgaccagtccttcaacgactacctctcagccgccaacatgctttaccccatcccagccaaggccaccaacgtgcccatttccatcccctcgcgcaactgggccgcctttcgcggctggagtttcacccgcctaaaaaccaaggaaactccctccctcggctcgggttttgacccctactttgtttactcgggcaccatcccctacctcgacgggaccttctacctgaaccacacctttaagaaggtctccatcatgttcgactcctcggttagctggcccggcaacgacaggctgcttacgccgaacgagtttgaaattaagcgcagcgtcgacggggagggctataacgtggcccaatgcaacatgaccaaggactggttcctggtccagatgctttcccactacaacattggctaccagggcttccatgtgcctgagggctacaaggaccgcatgtactccttctttcgcaacttccagcccatgagtaggcaggtggttgatgagattaactacaaggattacaaggccgttgccctgcccttccagcacaacaactcgggcttcaccggctacctcgcacctaccttgcgccagggacagccgtaccccgccaacttcccctacccgcttatcggacagaccgccgtgccctccgttacccagaaaaagtttctctgcgacagggtcatgtggcgcatccccttctccagcaacttcatgtctatgggcgcccttaccgacctgggtcaaaacatgctttacgccaactcggcgcacgcgctcgacatgacctttgaggtggaccccatggatgagcccaccctcctgtatcttctctttgaagttttcgacgtggtcagagtgcaccagccgcaccgcggcgtcatcgaggccgtctacctgcgcacgcccttctccgccggcaacgccaccacctaa

SEQ ID NO: 207 - DNA, 2817 bp, Adenovirus D9
  MISC_FEATURE (1)..(2817): Hexon Gene
atgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagtctggcccccaagggtgcccccaactccagccagtggcttgcaaaagacaccaatgctggcgatcaagcattaaaaacccacacacatggcgtagctgctatggggggaacagatatcacagcaaagggtttgcaaattggtgttgacacgactgaaaacaagaatgagcctatttatgcaaatgaaatataccagccagaacctcaggtaggagaggaaaacttgcaagatgttgaaaacttttatggaggcagagctcttaaaaaagaaaccaaaatgaaaccttgctatggctcgtttgccagacccacaaatgaaaaaggcggtcaagccaaatttttaactgacggcgatggtcagctaactaaaaatcatgatatcacaatgaatttctttgacactcctggaggaacagttggtcaggatactgaacttgaagcagacattgttatgtatgctgagaatgtgcatctggaaactccagacacgcatgtggtgtacaaaccaggaacttctgatgagagttcagaagcaaatttggttcagcagtccatgccaaacaggcccaactacatcggcttcagggacaactttgtgggtctcatgtactataacagcactggcaacatgggtgtgctggctggtcaagcatctcagttgaatgctgtggtcgacttgcaagacagaaacacagagctgtcttaccagctcttgctagattctctgggtgacagaaccagatactttagcatgtggaactctgcagtggacagttatgatcctgatgtcaggattattgaaaatcacggtgtggaagatgaacttccaaactattgcttcccattggatggagctggcactaatgctacctaccaaggtgtaaaagttaaaaatggccaagatggagatgtaaacgcagattgggaaaaagatccaaatcttgcttcacgaaaccaaatatgcaagggtaacatcttcgccatggagatcaacctccaggccaacctgtggaagagttttctgtactcgaatgtggccctgtacctgcccgactcatacaagtacacgccggccaacgtcacgctgcccgccaataccaacacctacgagtacatgaacggccgcgtggtagccccctcgctggtggacgcctacatcaacatcggcgcccggtggtcgctggaccccatggacaacgtcaacccattcaaccaccaccgcaacgcgggcctgcgttaccgctccatgcttctgggcaacggccgctacgtgcccttccacatccaagtgccccaaaagttctttgccatcaagaacctgctcctgctccccggctcctacacctacgagtggaacttccgcaaggatgtcaacatgatcctgcagagttccctcggaaacgacctgcgcgtcgacggcgcctccgtccgcttcgacagcgtcaacctctacgccacattcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaagaaactccctccctcggctcgggtttcgatccctactttgtatactcgggttccatcccctacctcgacgggaccttctacctcaaccacaccttcaagaaggtctccatcatgttcgactcctcggtcagctggcccggcaacgaccggctgctcacgccgaacgagttcgagatcaagcgcagtgtcgacggggagggctacaatgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcacccaccatgcgtcaggggcagccctaccccgccaacttcccctatcctctcatcggccagacagccgtgccctctgtcacccagaaaaagttcctctgcgacagggtcatgtggcgcatccccttctccagcaacttcatgtccatgggcgccctcaccgacctgggtcagaacatgctctatgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaa

SEQ ID NO: 208 - DNA, 2880 bp, Adenovirus D10
  MISC_FEATURE (1)..(2880): Hexon Gene
atgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagcctggcccccaagagcgcccccaatccaagtcagtggaccgccaatgaaaaacaaactggcggtcaaccaaaatctgttacccaaacatttggatctgctccaatgggaggcagcaatattactattgaaggattggttattggaactaaggaggaagaaggcaatgccactgaagaaatattcgcagataaaacattccagccagaacctcaagtaggagaagaaaactggcaggaaacagaagccttctatggaggaagggctcttaaaaaggataccaaaatgaaaccatgttacggttcatttgctagacccaccaatgaaaaaggagggcaagcaaaattaaagctcaacgatcagggtcagccaactaaagattatgacatagacctggcattctttgatactccgggcggaacacctccaacaggcagtggtcaacaggaagaatacaaagcagacattgttatgtacactgaaaatgtcaaccttgaaaccccagacacccacgtggtatataagccaggaaaagaggatgagagttctgaaacaaatttgacacagcagtccatgcccaacagacctaactacattggctttagggacaactttgtggggctcatgtattacaacagcaccggcaatatgggtgtgctggctggtcaggcttctcagttgaacgctgtggtcgacttgcaagacagaaataccgagctatcttaccagctattgctagattctttgggcgacaggaccagatactttagcatgtggaactctgcggtggacagctatgatcccgatgtcaggatcattgagaatcacggtgtggaagatgaacttccaaactattgcttcccattgaatggtactggcaccaattccacttatcaaggcgtaaaggtgaaaacaggtcaggatggagctgaggagaccgagtgggataaagatgaaactgttgcaagacaaaatcaaatcgccaagggcaacgtctatgccatggagatcaacctccaggccaacctgtggaagagttttctgtactcgaacgtagccctgtacctgcctgactcatacaagtacacgccggccaacgtcacgctgcccgccaataccaacacctacgagtacatgaacggccgcgtggtagccccctcgctggtggacgcctacatcaacatcggcgcccggtggtcgctggaccccatggacaacgtcaacccattcaaccaccaccgcaacgcgggcctgcgttaccgctccatgcttctgggcaacggccgctacgtgcccttccacatccaagtgccccaaaagttctttgccatcaagaacctgctcctgctccccggctcctacacctacgagtggaacttccgcaaggatgtcaacatgatcctgcagagttccctcggaaacgacctgcgcgtcgacggcgcctccgtccgcttcgacagcgtcaacctctacgccacattcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaagaaactccctccctcggctcgggtttcgatccctactttgtatactcgggctccatcccctatctcgatgggaccttctacctcaaccacaccttcaagaaggtctccatcatgttcgactcctcggtcagctggcccggcaacgaccggctgctcacgccgaacgagttcgagatcaagcgcagtgtcgacggggagggctacaatgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctacctcgcacccaccatgcgtcaggggcagccctatcccgccaacttcccctacccgctcatcggccagacagccgtgccctccgtcacccagaaaaagttcctctgcgacagggtgatgtggcgcatccccttctccagcaacttcatgtccatgggcgccctcaccgacctgggtcagaacatgctctacgccaactcggctcacgcgctcgacatgaccttcgaggtggaccccatggatgagcccaccctcctctatcttctctttgaagttttcgacgtggtcagagtgcaccagccgcaccgcggcgtcatcgaggccgtctacctgcgcacgcccttctccgccggcaacgccaccacctaa

SEQ ID NO: 209 - DNA, 2820 bp, Adenovirus D13
  MISC_FEATURE (1)..(2820): Hexon Gene
atggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacgtactttgacatccgcggcgtcctggaccgcggtcccagcttcaaaccctactcgggcacggcttacaacagcctggcccccaagggcgcccccaatcccagtcagtggactactaaagaaaagcagaccggagtaaatgcaggagacaaagaagttaccaagacatttggaattgccgccatgggaggcagtaatatttctgaaaacggtttgcagattggaactgacacaacagcagatggcacaaaaccaatatatgcagacaaaactttccagccagaacctcaagttggagaagaaaactggcaggataatgatgaatattatggaggcagggctcttaaaaaagataccaaaatgaagccatgctatggttcatttgctaaacccacaaacaaggaaggagggcaggctaaattgaaagaaacacccaatggcgctgatcctcaatatgatgtggacatggctttctttgactcaacaactataaacattccagatgtagtgttgtacactgaaaatgtagacttggaaactccagacacacatgtggtgtacaaaccaggcaaagaggatgacagttcagaagtaaacttaactcagcagtccatgcctaacagacccaactacattggcttcagagacaactttgtggggctcatgtactacaacagcactggcaacatgggtgtgctggctggtcaggcttctcagttgaatgctgtggttgacttgcaagacagaaacaccgaactgtcttaccagctcttgctagattctctgggtgacagaacaagatactttagcatgtggaactctgcggtggacagttatgatcccgatgtcaggatcattgaaaatcacggtgtggaagatgaacttccaaactactgcttccccttggacggtattcaaactaattcagcctaccaaggtgttaaactaaaggataatccaacaggaggcggagctaatggagattgggtaaaggatgataccatttcagcccataatcaaattgggaagggcaacatctttgccatggagatcaacctccaggccaacctctggaagagttttctgtactcgaacgtggccttgtacctgcccgactcctacaagtacacgccggccaacgtcacgctgcccgccaacaccaacacctacgagtacatgaacggccgcgtggtagccccctcgctggtggacgcctacatcaacatcggcgcccgctggtcgttggaccccatggacaacgtcaaccccttcaaccaccaccgcaacgcgggcctgcgctaccgctccatgcttctgggcaacggccgctacgtgcccttccacatccaagtgccccaaaagttctttgccatcaagaacctgctcctgcttcccggctcctacacctacgagtggaacttccgcaaggatgtcaacatgatcctgcagagttccctcggcaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcactcgtctgaagaccaaggaaactccctctctcggttcgggtttcgacccctactttgtctactcgggctccattccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgaaatcaactacaaggactacaaggccgtcaccctgcccttccagcacaacaactcgggcttcaccggctacctggcccccaccatgcgtcaggggcagccctaccccgccaacttcccctacccgctcatcggctccaccgcagtcccctccgtcacccagaaaaagttcctctgcgacagggtcatgtggcgcatccccttctccagcaacttcatgtccatgggcgccctcaccgacctgggtcagaacatgctctatgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaa

SEQ ID NO: 210 - DNA, 2865 bp, Adenovirus D17
  MISC_FEATURE (1)..(2865): Hexon Gene
atgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacgtactttgacatccgcggcgtcctggaccgcggtcccagtttcaaaccctactcgggcacggcttacaacagccttgcccccaagggcgctcccaatcccagtcagtgggttgccaaagaaaatggtcagggaactgataagacacatacttatggctcagctgccatgggaggaagcaacatcaccattgaaggtttagtaattggaactgatgaaaaagctgaggatggcaaaaaagatatttttgcaaataaactttatcagccagaacctcaagtaggtgaagaaaactggcaagagtctgaagccttctatggaggcagagctcttaagaaagacacaaaaatgaagccctgctatggctcatttgcaagacctaccaatgaaaaaggcggacaagctaaatttaagccagtggaagaggggcagcaacctaaagattatgacatagatttggctttctttgacacacctggaggcaccatcacaggaggcacagacgaagaatataaagcagacattgtgttgtacactgaaaatgtcaaccttgaaaccccagacacccacgtggtatacaagccaggaaaagaggatgacagttcagaagtaaatttgacacagcagtccatgcccaacaggcctaactacattggcttcagagacaactttgtgggactcatgtactacaacagtactggcaacatgggtgtgctggctggtcaggcctctcaattgaatgctgtggtcgacttgcaagacagaaacaccgagctgtcttaccagctcttgctagattctctgggtgacagaaccagatacttcagcatgtggaactctgcggtggatagctatgatccagatgtcaggatcattgaaaatcatggtgtggaagatgaacttccaaactattgcttcccattgaatggcactggcaccaattcaacatatcttggcgtaaaggtgaaaccagatcaagatggtgatgttgaaagcgagtgggataaagatgataccattgcaaggcagaatcaaatcgccaagggcaacgtctttgccatggagatcaacctccaggccaacctgtggaagagttttctgtactcgaacgtggccttgtacctgcccgactcctacaagtacacgccggccaatgttacgctgcccgccaacaccaacacctacgagtacatgaacggccgcgtggtagccccctcgctggtggacgcctacatcaacataggcgcccgatggtcgctggaccccatggacaacgtcaaccccttcaaccaccaccgcaatgcgggcctgcgctaccgctccatgcttctgggcaacggccgctacgtgcccttccacatccaagtgccccaaaagttctttgccatcaagaacctgctcctgctcccgggctcctacacctacgagtggaacttccgcaaggatgtcaacatgatcctgcagagttccctcggcaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgcttttcgcggctggagtttcacccgtctgaaaaccaaggaaactccctccctcggctcgggttttgacccctactttgtctactcgggctcgatcccctaccttgacgggaccttttaccttaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcacccaccatgcgccaagggcagccctaccccgccaacttcccctacccgctcatcggccagacagccgtgccatccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggaaacgccaccacctaa

SEQ ID NO: 211 - DNA, 2817 bp, Adenovirus D20
  MISC_FEATURE (1)..(2817): Hexon Gene
atgatgccgcagtgggcgtacatgcacatcgccgggcaggacgcctcggagtacctgagcccgggtttggtgcagtttgcccgcgccaccgacacgtacttcagcctgggcaacaagtttaggaaccccacggtggctcccacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggcgcccccaactccagtcagtggcttgcaaaagataccaatgctgctggtcaaccagataaaactcacacctatggcgttgcagccatgggtggagaagacattacagaaaagggtcttcaaattggcattgatgaaactaaagaagaaaataacaagatatttgccaatgaaatataccaaccagaacctcaagtgggagaagaaaactggcaggaaacatttgttttttatggcggtagagctcttaagaaggataccaaaatgaaaccatgctatggctcatttgccagacctactaatgaaaagggaggtcaggctaaatttgtacttgatcaggaaggaaagccaactaaaaatcatgacatcacaatggctttctttgatactcctggtgggcaattaaatggaaaagatgaacttaaggcagacattgtcatgtacactgaaaatgtcaacctggaaacacctgacacccatgttgtttacaaacctggaaaagaggatgacagttcagaaatcaatttggttcaacagtccatgcccaacagacccaactacattggcttcagggacaactttgtagggcttatgtattacaacagcactggcaacatgggtgtgctggcaggtcaggcctctcagttgaatgctgtggtagacttgcaagacagaaacacagagctgtcttaccagctcttgctagattcgctgggtgacagaaccagatactttagcatgtggaactctgcggtggacagctatgatccagatgtcaggatcattgagaatcatggtgtggaagatgaacttccaaactattgcttcccattggatggtgctggaactaatgcagtttaccaaggtgtaaaaattacagatggaaatgatggcgatgtcaatgatgactgggaaaaagacaccgcagtatctgaacgtaatcagatatgcaaaggcaatatctatgctatggagatcaacctccaggccaacctgtggaagagttttctgtactcgaacgtggccctgtacctgcccgactcctacaagtacacgccggccaacgtcacgctgcccgccaacaccaacacctacgagtacatgaacggccgcgtggtagccccctcgctagtggacgcctacatcaacatcggcgcccgctggtcgctagaccccatggacaatgtcaaccccttcaaccaccaccgcaatgcgggcctgcgctaccgttccatgcttctgggcaatggccgctacgtgcccttccacatccaagtgccccaaaagttctttgccatcaagaacctgctcctgctccccggctcttacacctacgagtggaactttcgcaaggacgtcaacatgatcctgcagagttccctcggaaacgacctgcgcgtcgacggcgcctccgtccgcttcgacagcgtcaacctctacgccaccttcttccccatggcgcacaataccgcctccaccctggaagccatgctgcgcaacgacaccaacgaccagtccttcaacgactacctctcggcagccaacatgctttaccccatcccggccaaggccaccaacgtgcccatttccatcccctcgcgcaactgggccgccttccgcggctggagtttcacccggctcaagaccaaggaaactccatcccttggctcgggtttcgacccctactttgtctactcgggctccatcccctacctcgacgggaccttctacctcaaccacaccttcaaaaaggtctccatcatgtttgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccattacaacatcggttaccagggcttccatgtgcccgagggctacaaggaccgcatgtactccttcttccgcaacttccagcccatgagcaggcaggtggtcgatgagatcaactacaaggactacaaggccgtcaccctgccattccagcacaacaactctggcttcaccggctacctcgcacccaccatgcgtcaggggcagccctaccccgccaacttcccctacccgctcatcggccagacagccgtgccatccgtcacccagaaaaagttcctctgcgacagagtcatgtggcgcatccccttctccagcaacttcatgtccatgggcgcccttaccgacctgggtcagaacatgctctacgccaactcggcccacgcgctcgacatgacctttgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaa

SEQ ID NO: 212 - DNA, 2775 bp, Adenovirus D24
  MISC_FEATURE (1)..(2775): Hexon Gene
atgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcttacaacagcctggcccccaaaggcgcccccaactctagtcagtgggaacaagctaaagctaccaatgccggtcaaaaggaaactcacacatttggagtagccgctatgggcggagaagacattacagtgaaaggtcttcaaattggaactgatgaaactaaggaagatggagaggatgaaatttttgcagatcaaacattccagccagaacctcaagtgggagaacagaactggcaagaaacgtttgttttctatggaggcagagctcttaagaaagaaaccaaaatgaagccatgttatggctcttatgcgagacccacaaatgaaaagggaggacaggctaaatttacacttgatgaaaaaggtcagccaaccaaaattcctgatattacaatggatttctttgatagtccacaagatgatacatcaggtgtaactaataagccagatattgtcatgtatgcagaaaatgtaaatttagaagctcctgacacacatgtagtttacaaaccaggcaaagatgattctagttcttccgctaacctcacacaacaggccatgcctaacagaccgaactacatcgggttcagagacaactttgtgggtcttatgtactacaatagtactggcaacatgggtgtgctggctggtcaggcctctcagttgaatgctgtggtcgacttgcaagacagaaacaccgagctgtcttaccagctattgctagattctctgggtgacagaaccagatactttagcatgtggaattctgcagtggacagctatgaccccgatgtcaggatcattgagaatcacggtgtggaagatgaacttccaaactattgcttcccactgaatggcagtggttctaacagcacatacaaaggtgttaaagctggaactggaaacaattgggatgacgatgaaaatgttgcaagacaaaatcagattggcactggcaacctgttcgccatggagatcaacctccaggccaacctatggaagagttttctgtactcgaacgtggccctgtacctgcccgactcctacaagtacacgccggccaacgtcacgctgcccaccaacaccaacacctacgactacatgaacggccgcgtggtagccccctcgctggtggacgcctacatcaacattggcgcccgctggtcgctggaccccatggacaatgtcaatcccttcaaccaccaccgcaacgcgggcctgcgctaccgctccatgctcctgggcaacggccgctacgtgcccttccacatccaagtgccccaaaagttctttgccatcaagaacctgcttctgctccccggttcctacacctacgagtggaacttccgcaaggacgtcaacatgatcctgcagagttccctcggcaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaggaaactccctccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgttgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctacccttccagcacaacaactcgggcttcaccggctaccttgcgcccaccatgcgccaggggcagccctaccccgccaacttcccctacccgctcatcggctccaccgcagttccctccgtcacccagaaaaagttcctctgcgacagggtcatgtggcgcatcccattctccagcaactttatgtccatgggcgccctcaccgacctgggtcagaacatgctctatgccaactcggcccacgcgctcgacatgacctttgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgctaccacttaa

SEQ ID NO: 213 - DNA, 2838 bp, Adenovirus D25
  MISC_FEATURE (1)..(2838): Hexon Gene
atggccaccccatcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagcctggcccccaagggcgctcccaattccagtcagtgggaagaaaaaaagagtggagccggaaatcaaaccgaaactcatacgtttggcgttgctcccatgggcggaactaacatcacaattagcggtttgcaaattggaactgaggaagaagatggaaatcctacaaaggagatttttgcagataaaacattccagcctgaacctcaaataggagaagaaaactggcaggacactgagaatttttatggcggtagagctcttaagaaagacaccaaaatgaaaccttgctatggctcttttgccagacctactaacgaaaagggaggtcaagctaagttaaaacttgacgcccaaggtcagtcaactaaagattatgacattgacctggctttctttgactcacctggaggaaatacaacagctggtggtcaagaagagcttaaagcagacattgtcatgtacactgagaatgcttatctggaaacaccagatacccatgtagtttacaagccaggaacctctgatgacagttctgccgccaacttggttcagcaatccatgcccaacagacccaactacattggcttcagagacaactttgtgggtctcatgtattacaacagcactggcaacatgggtgtgctggctggtcaggcctctcagttgaatgccgtggtcgacttacaagacagaaacaccgagctgtcttaccagctcttgctagattctctgggcgacagaaccaggtactttagcatgtggaactctgcggtggacagctatgatcccgacgtcaggatcattgaaaatcacggtgtggaagatgaacttccaaactattgcttcccattggatggctctggcactaattcagcttatcaaggtgttaaagttaaaaatggggaagatggtgatattgagagcgaatgggaaaaagacaccaatgtcgcagctcgtaaccaactgtgcaagggtaacatctttgccatggagatcaacctccaggccaacctgtggaagagttttctgtactcgaacgtggccctgtacctgcccgactcatacaagtacacgccggccaacgtcaagctgcccaccaacaccaacacctacgagtacatgaacggccgcgtggtagccccctcactggtggacgcctacgtcaacatcggcgcccgctggtcgctggaccccatggacaacgtcaaccccttcaaccaccaccgcaatgcgggcctgcgctaccgctccatgcttctgggcaacggccgctacgtgcccttccacatccaagtgccccaaaagttctttgccatcaagaacctgctcctgctccccggctcctacacctacgagtggaacttccgcaaggacgtcaacatgatcctgcagagttccctcggaaacgacctgcgcgtcgacggcgcctccgtccgcttcgacagcatcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaggaaactccctccctcggctcgggtttcgacccctactttgtctactcgggctccatcccctacctcgacgggaccttctacctcaaccacaccttcaagaaggtttccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcacccaccatgcgtcaggggcagccctaccccgccaacttcccctacccgctcatcggctccaccgcagtcccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgactttcgaggtggaccccatggatgagcccaccctcctctatcttctcttcgaagttttcgacgtggtcagagtgcaccagccgcaccgcggcgtcatcgaggccgtctacctgcgcacacccttctccgccggcaacgccaccacctaa

SEQ ID NO: 214 - DNA, 2889 bp, Adenovirus D26
  MISC_FEATURE (1)..(2889): Hexon Gene
atgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatcccagtcagtgggaaacaaaagaaaagcaaggaactactggaggagtgcagcaagaaaaagatgtcacaaaaacatttggtgtggctgccaccggcggaattaatataacaaaccagggtctgttactaggaactgacgaaaccgctgagaatggcaaaaaagacatttatgcagacaagactttccagccagaacctcaagttggagaagaaaactggcaggaaaatgaagccttctatggaggaagggctcttaaaaaggacactaaaatgaaaccatgctatggatcttttgctagacctactaatgagaaaggaggtcaggcaaagttcaaaccagttaatgaaggagaacaacctaaagatctggatatagattttgcttactttgacgtccctggcggaagtcctccagcaggtggtagtggggaagaatacaaagcagatataattttgtacactgaaaatgttaatcttgaaacaccagacactcatgtggtttacaagccaggaacttcagataacagttcagaaatcaatctggttcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattgaatggcactggaaccaattccacttatcaaggtgtaaagattacaaatggtaatgatggtgctgaagaaagtgagtgggagaaagacgatgcaatttctagacaaaaccaaatctgcaagggcaatgtctacgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggaccccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaa

SEQ ID NO: 215 - DNA, 2841 bp, Adenovirus D27
  MISC_FEATURE (1)..(2841): Hexon Gene
atgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgctttgtgcccgtggatcgcgaggacaccacgtactcatacaaggcgcgcttcactctggccgtgggcgacaaccgggtgctagacatggccagcacgtactttgatatccgcggcgtcctggaccgcggtcccagcttcaaaccctactcgggcacggcttacaacagcctggctcccaagggcgcccccaactccagtcagtggactgctaaagaaaatcaaaaagatgttacaaaaacatttggtgtagctccaatgggaggaattaatatatcaaaggatggtttacaaattggcgttgaagaaacagttgacaagcaagaaaaggaaatttatgctgacaagagtttccagccagaacctcaagtaggagaagaaaactggcaagagtcagaagccttctatggcggcagagctcttaagaaggacaccaagatgaaaccatgctatggttcatttgccagacccactaatgaaaagggaggtcaggcaaaattcaaagcacctgctgtcgaaggagaacagcctaaggaacttgatattgactttgctttctttgacactgactcaggtgacacagaatataaagcagatattgttatgtatgctgaaaacgtgaatctggaaactccagacactcatgttgtttacaaaccaggcaaagaggatgatagctctgaagcaaacttggttcagcagtccatgccaaacagaccaaactacattggctttagagacaattttgtggggctcatgtattacaacagcactggtaacatgggtgtgctggctggtcaggcctctcagttgaatgctgtggtcgacttgcaagacagaaacacagagctgtcttaccagctattgctagattctctgggtgacagaaccaggtactttagcatgtggaactctgcggtggacagctatgatcccgatgtcaggatcattgaaaatcatggtgtggaagatgaacttccaaactattgcttcccattggatggctctggaactaattccacatatcaaggtgtaaaaattacagatggaaatggtgctttgcaaaacggatgggcaaaagatgatgcaatctcgagacaaaaccaaatctgcaagggcaacatctacgccatggagatcaacctccaggccaacctgtggaagagttttctgtactcgaacgtggccctgtacctgcccgactctttcaagtacacgccggccaacgtcactctgcccaccaacaccaacacctacgagtacatgaacggccgcgtggtggccccctcgctggtggacgcctacatcaacatcggcgcccgctggtcgctggaccccatggacaatgtcaaccccttcaaccaccaccgcaacgcgggcctgcgctaccgctccatgttgctaggcaacggccgctacgtgcccttccatatccaagtgccccaaaagttctttgccatcaagaacctgctcctactcccgggctcctacacctacgagtggaacttccgcaaggacgtcaacatgatcctgcagagttccctcggcaacgacctgcgcgtcgacggcgcctccgtgcgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcactcgcctgaaaaccaaggaaactccctcgctcggctcgggtttcgacccctactttgtctactcgggctccattccctacctcgacgggaccttctacctaaaccacaccttcaagaaggtctccatcatgttcgactcctcggtcagctggcccggcaacgaccggctgctcacgccgaacgagttcgaaatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtattccttcttccgcaacttccagcccatgagcaggcaggtggtcgatgagatcaactacaaggactacaaggccgtcaccctgcccttccagcacaacaactcgggcttcaccggctacctcgcacccaccatgcgtcaggggcagccctatcccgccaacttcccctacccgctcatcggctccaccgcagtgccctccgtcacccagaaaaagttcctctgcgacagggtcatgtggcgcatccccttctccagcaacttcatgtccatgggcgcccttaccgacctgggtcagaacatgctctacgccaactcggctcacgcgctcgacatgaccttcgaggtggaccccatggatgagcccaccctcctctatcttctctttgaagttttcgacgtggtcagagtgcaccagccgcaccgcggcgtcatcgaggccgtctacctgcgcacgcccttctccgccggcaacgccaccacctaa

SEQ ID NO: 216 - DNA, 2862 bp, Adenovirus D33
  MISC_FEATURE (1)..(2862): Hexon Gene
atgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctcgaccgcggtcccagcttcaaaccctactcgggcacggcttacaacagcctggcccccaagggcgcccccaattccagtcagtgggaacagaaaaaggccactgggggagctgatgcaaaggaaacacatacattcggtgtagccgctatgggaggattgaacattacagacaaaggtttgcaaattggaatagatgaagataatgtagatggagatgatgagatatatgctgacaaaacttttcaaccagaacctcaagtgggagaggaaaactggaaagaaagttttaatttctatggaggcagagctattaagaaagacaccaaaatgaagccatgctatggttcctatgccagacccaccaatgttaagggaggtcaggctaaacttaaaactggagaagatatagaccctaacaaggactttgacatagacatggctttctttgatctaaagcaagctgacacaggaggtaataacaatcaagcagacgtggttatgtataccgaaaatattcatctggaaactccagacactcatgtggtgtacaagccaggcaaggaagatgcaagttctgaaattaacttgactcagcagtccatggccaacagacccaactacattggcttcagagacaactttgtagggctcatgtactacaacagcactggcaacatgggtgtgctggccggtcaggcatctcagttgaatgcagtggtcgacttgcaagacagaaacaccgagctgtcttaccagctcttgctagattctctgggcgacagaaccagatactttagcatgtggaactctgctgtggacagctatgatcccgatgtcaggatcattgagaatcacggtgtggaagatgaacttccaaactattgcttcccattggacggatctggcagcagtactgcttttcagggagttaaagtaaaaaccccggctggtactggtcaaaacactgtatgggaagttaacaatgatgctgcaacgcataaccaaattgcaagaggcgacctgtacgccatggagatcaacctccaggccaacctgtggaagagttttctgtactcgaacgtggccctgtacctgcccgactcctacaagtacactccggccaatgtcacgctgcccaccaacaccaacacctacgagtacatgaacggccgcgtggtggccccctcgctggtggacgcctacatcaacatcggcgcccgctggtcgctggaccccatggacaacgtcaaccccttcaaccaccaccgcaacgcgggcctgcgctaccgctccatgcttctgggcaacggccgctacgtgcccttccacatccaagtgccccaaaagttctttgccatcaagaacctgctcctgctcccgggctcctacacctacgagtggaacttccgcaaggatgtcaacatgatcctgcagagttccctcggcaacgacctgcgcgtcgacggcgcctccgtccgcttcgacagcgtcaacctctacgccaccttcttccccatggcacacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaggaaactccctccctcggctcgggtttcgacccctactttgtatactcgggctccatcccctaccttgacgggaccttctacctcaaccacaccttcaagaaggtctccatcatgttcgactcctcggtcagctggccaggcaacgaccggctgctcacgccgaacgagttcgagatcaagcgcagcgtcgacggggagggctacaacgtggcccaatgcaacatgaccaaggactggttcctcgtccagatgctctcccactacaacatcggttaccagggcttccatgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctacctcgcgcccaccatgcgccaggggcagccctaccccgccaacttcccctacccgctcatcggctccaccgccgtgccctccgtcacccagaaaaagttcctctgcgacagggtcatgtggcgcatccccttctccagcaacttcatgtccatgggcgccctcaccgacctgggtcagaacatgctctatgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacataa

SEQ ID NO: 217 - DNA, 2850 bp, Adenovirus D37
  MISC_FEATURE (1)..(2850): Hexon Gene
atgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacttactttgacatccgcggcgtcctggaccgcggcccaagcttcaaaccctactcgggcacggcttacaacagcctggcccccaagggcgcccccaatcccagtcagtggactaccaaagaaaagcaaaacggaggaactggagcagaaaaagatgttacaaagacatttggacttgccgccatgggaggcagtaatatttctaaagacggtttgcagattggaactgacaaaacagcaaatgctgaaaaaccaatctatgcagacaaaactttccagccagaacctcaagttggagaagaaaactggcaggataatgatgaatattatggcggcagggctcttaaaaaagataccaaaatgaagccatgctatggttcatttgctaaacccacaaacaaggaaggtgggcaggctaaattgaaagaaacacccaatggtaccgatcctcaatacgatgtggacatggctttctttgactcaagcactataaatataccagatgtggtgttgtacactgaaaatgtagatttggaaactccagatacacatgtggtgtacaaaccaggcaaagaggatgacagttctgaagctaatttaactcagcagtccatgcctaacagaccaaactacattggcttcagagacaactttgtggggctattgtactacaacagcactggcaacatgggtgtgctggctggtcaggcttctcagttgaatgccgtggtcgacttgcaagacagaaacaccgaactgtcttaccagctcttgctagattctcttggtgacagaaccagatattttagtatgtggaactctgcggtggacagctatgatcccgatgtcaggatcattgagaaccacggtgtggaagatgaacttcctaactattgcttccccttggacggtgttcaaactaattcagcctatcaaggtgttaaactaaagcctgatcaaacaggaggcggagttaatggagattgggtaaaggatgatgacatttcagcccataatcaaattggaaagggcaacatctttgccatggagatcaacctccaggccaacctgtggaagagttttctgtactcgaacgtggccctgtacctgcccgactcctacaagtacacgccggccaacgtcacgctgcccgccaacaccaacacctatgagtacatgaacggccgcgtggtagccccctcgctggtggacgcctacattaacatcggcgcccgctggtcgctggaccccatggacaacgtcaacccctttaaccaccaccgcaatgcgggcctgcgctaccgctccatgcttttgggcaatggccgctacgtgcccttccacatccaagtgccccaaaagttctttgccatcaagaacctgctcctgctccccggctcctacacctacgagtggaacttccgcaaggatgtcaacatgatcctgcagagttccctcggaaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatttccatcccctcgcgcaactgggccgccttccgcggctggagtttcacccggctcaagaccaaggaaactccctcccttggctcgggttttgacccctactttgtctactcgggctccatcccctacctcgacgggaccttctacctcaaccacaccttcaagaaggtttccatcatgttcgactcctcggtcagctggcccggcaacgaccggctgcttacgccgaacgagttcgagatcaagcgcagcgtcgacggggagggctacaacgtggcccaatgcaacatgaccaaggactggttcctcgtccagatgctctcccactacaacatcggctaccagggcttccatgtgcccgagggctacaaggaccgcatgtactccttcttccgcaacttccagcccatgagcaggcaggtggtcgatgagatcaactacaaggactacaaggcagtcaccctgcccttccagcacaacaactctggcttcaccggctacctggcacccaccatgcgtcaggggcagccctaccccgccaacttcccctacccgctcatcggctccaccgcagtgccatccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaa

SEQ ID NO: 218 - DNA, 2856 bp, Adenovirus D69
  MISC_FEATURE (1)..(2856): Hexon Gene
atgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagtctggcccccaagggcgcccccaactccagtcagtgggaacagaaaaaggccaatgctggagatcaaaaggaaacacatacttatggtgtagctcctatgggtggagaaaacattacaattagcggtttgcaaattggaacagatactacaaatggcaaacaagacccgatatatgctaataagctgtatcaaccagagcctcaagtaggagaagaaaactggcaggaaacagaagccttctatggaggaagggctcttaaaaaggaaaccaagatgaaaccatgctatggctcatttgccagacccacaaatgaaaaaggaggacaggcaaaactaagagaccctgaaaaaagtcaagaagattttgacatagacctagcattctttgatactccgggaggaactttaacaggtggtggaacggaatacaaagcagacattgttatgtgcactgaaaatgttaatcttgaaaccccggacacccacgtggtgtataaaccaggcaaagatgatgacagttcagaaatcaacttggttcagcagtccatgcccaacagacctaactacatcggcttcagggacaactttgtgggtctcatgtactacaacagcactggcaacatgggtgtgctggccggtcaggcttctcagttgaatgctgtggtcgacttgcaagacagaaacacagagctgtcttaccagctcttgctagattctctgggcgacagaaccaggtactttagcatgtggaactctgcggtggacagctatgatcccgatgtcaggatcattgagaatcacggtgtggaagatgaacttcccaactattgcttcccattggatgggtctggcaccaatgctgcttatgaaggtgtaaaagttaaaaatggagaagatggggatcaagagagcgaatgggaaaaagacaccaatgtggcagatcgaaaccaaatatgcaagggcaacatctacgccatggagatcaacctccaggccaacctgtggaagagttttctgtactcgaatgtggccctgtacctgcctgactcctacaagtacacgccggccaacgtcacgctgcccgccaacaccaacacctacgagtacatgaacggccgcgtggtagccccctcgctggtggacgcctacatcaacatcggcgcccgctggtcgttggaccccatggacaacgtcaaccccttcaaccaccaccgcaatgcgggcctgcgctaccgctccatgcttctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggaaacgatctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaggaaactccctccctcggctcgggtttcgacccctactttgtctactcgggctccatcccctatctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaatgtggcccaatgcaacatgaccaaggactggttcctcgtccagatgctctcccactacaacatcggttaccagggcttccatgtgcccgagggctacaaggaccgcatgtactccttcttccgcaacttccagcccatgagcaggcaggtggtcgatgagatcaactacaaggactacaaggccgtcaccctgcccttccagcacaacaactctggcttcaccggctacctcgcacccaccatgcgtcaggggcagccctaccccgccaacttcccctacccgctcatcggccagacagccgtgccatccgtcacccagaaaaagttcctctgcgacagggtcatgtggcgcatccccttctccagcaacttcatgtccatgggcgcccttaccgacctgggtcagaacatgctctacgccaactcggcccacgcgctcgacatgacctttgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaa

SEQ ID NO: 219 - DNA, 2775 bp, Adenovirus E4
  MISC_FEATURE (1)..(2775): Hexon Gene
atgcacatcgccggacaggacgcttcggagtacctgagtccgggtctggtgcagttcgcccgcgccacagacacctacttcagtctggggaacaagtttaggaaccccacggtggcgcctacccacgatgtgaccaccgaccgcagccagcggctgacgctgcgctttgtgcccgtggaccgggaggacaacacctactcgtacaaagtgcgctacacgctggccgtgggcgacaaccgcgtgctggacatggccagcacctactttgacatccgcggcgtgctggatcggggccctagcttcaaaccctactccggcactgcctacaacagcctggctcccaagggagcgcccaacacctgccagtggaaggattctgacagcaaaatgcatacctttggggcagctgccatgcccggtgttactgggaaaaagatagaagctgatgggctgcctattagaatagattcaacttctggaactgacacagtaatttatgctgataaaactttccaaccagaaccacaagttggaaatgacagttgggttgacaccaatggtgcagaggaaaaatatggaggcagagctctaaaggacactacaaaaatgaaaccctgttatggttcattcgccaagcctaccaacaaagaaggtggtcaggctaacttaaaagattcagaacccgccgccaccactcctaactatgatatagacctggctttctttgacagcaaaactattgttgctaactacgatccagatattgtaatgtacacagaaaatgttgacttgcagactccagatactcatattgtatacaaacctggaacagaggacaccagctctgaatccaatttgggtcagcaggccatgcctaacagacccaactacattggcttcagagacaattttatcgggctcatgtactacaacagcactggcaatatgggggtgctggccggtcaggcctctcagctgaatgctgtggttgacttgcaagacagaaacactgaactgtcctaccagctcttgcttgactctctgggtgacagaacccggtatttcagtatgtggaatcaggcggtggacagctatgatcctgatgtgcgcattattgaaaaccatggtgtggaggatgaattgccaaactattgctttccgttgaatggtgtgggattgacagacacttaccagggtgttaaagttaaaacagatgcaggttctgaaaagtgggacaaagatgacaccacagttagtaatgctaatgaaatccatgtaggcaatccttttgccatggaaatcaacatccaagccaacctgtggaggaacttcctctatgccaatgttgccctctatttgcctgataaatacaaatacacaccggccaacatcaccctgcccaccaacaccaacacctacgagtacatgaacggccgggtggtggcgccctcgctggtggacgcctacattaacattggggcgcgctggtcgctggaccccatggacaacgtaaatcccttcaaccaccaccgcaatgcgggcttgcgctaccgctccatgctcctgggcaacgggcgctacgtgccattccacatccaggtgccccagaaattttttgccattaagagcctcctgctcctgcccgggtcctacacctacgagtggaacttccgcaaggacgtcaacatgatcctgcagagttcccttggcaacgacctgcgcacagacggggcctccatcaccttcaccagcattaacctctacgccaccttcttccccatggcgcacaacaccgcctccacgcttgaggccatgctgcgcaacgacaccaatgaccaatccttcaacgactacctctcggcggccaacatgctctatcccatcccggccaacgccaccaacgtgcccatctccatcccctcgcgcaactgggccgcctttcgcggctggtccttcacgcgactcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataa

SEQ ID NO: 220 - DNA, 2763 bp, Adenovirus G52
  MISC_FEATURE (1)..(2763): Hexon Gene
atggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctcaccctgcgctttgtgcccgtagaccgggaggacaccgcgtactcttacaaagtgcgctacacgctggccgtaggggacaaccgagtgctggacatggccagcacctacttcgacatccggggggtgctggatcggggtcctagcttcaagccctactccggcaccgcttacaactccctggctcccaagggagctccaaactccgtagagtggccggataatactaaaacaaaagtgagagcccaagcaccgtttgtaagcgacgaaatcactaaagacggcataaaggttggaacagataccgcaaccacccaacaaagcatttacgccgataaaacgtatcaacctgaaccacaagtaggggaaacacagtggaacagcgatgtaggcactaatgataaagtggcaggaagagttttaaagaaaacgaccccaatgtatccttgttatggttcttacgcacgacccacgaacgaaaaaggagggcaggcgaaggctgacacccaagtggatatgcagttttttgccaccactgcagccaatacaacaccaaaagctgttctttatgctgaagatgttaacttagaaggtcccgatacgcacttggtgtttaaacccactgtgacagagggaacgacaagtgccgaagctttgctagcgcaacaagccgctccaaaccgtccaaattacattgcttttagggacaattttattggactaatgtattacaacagcacgggaaacatgggggtgcttgccggtcaggcttcgcagctaaatgcggtagtagatttgcaagatagaaatacggaactatcctaccagctgatgttggatgcactgggagacagaagtcgctacttttctatgtggaatcaagccgtagatagttatgatccagatgttagaattgtggaaaatcacggagtagaggacgaactaccaaactattgtttcccattgggaggaatggcggtcacagacacctactcccccataaaatccaataatggaagcggttggcaagtagacaacgatacgtttgccgacaggggggtggaaataggctcgggaaacatgttcgccatggagatcaatttgcaagccaacctgtggcgcagttttttgtattctaacattgggctatacctcccggactctttaaaattaacccctgacaacatcacactcccagaaaacaaaaacacctaccagtacatgaacgggcgtgtgacaccacccgggcttgtggacacatacgtcaatgtgggagcccgctggtcccccgatgttatggacagcatcaaccccttcaaccaccaccgcaatgctggccttcgctaccgttccatgctcctgggcaacggtcgctacgtaccattccacattcaggtgccccagaaattttttgccattaagaatcttttgctgctccccggttcctacacctacgagtggaacttccgcaaggacgtgaacatgattttgcaaagctcgctgggtaacgacctgcgagttgacggggccagcatacgcttcgacagcatcaacctgtatgctaactttttccccatggcccacaacacagcttccaccctggaagccatgctgcgcaacgacaccaatgaccagtccttcaacgactacctgtgcgcggccaacatgctgtatcccatccccgccaatgccaccagcgtgcccatctccatcccgtctcgcaactgggccgccttcaggggctggagttttacccgcctcaaaaccaaggagaccccctcgctgggctccgggttcgacccctactttgtctactccggctccattccctacctggacggtaccttctacctcaaccatacttttaagaaggtgtccatcatgtttgactcgtcggtcagctggcccggcaacgaccgcctgctaactccaaatgagtttgaaatcaagcgttcggtggacggtgaagggtacaacgtggcccagagcaacatgaccaaggactggttcctaattcagatgctcagccattacaacatcggctaccagggtttctacgtgcccgagaattacaaagaccgcatgtactccttctttagaaacttccaacctatgagccgtcaagtagtagatactgtggcttataaggactactatcaggacgttaagctcccctaccagcacaacaactcagggttcgtgggctacatgggtcccaccatgcgagaggggcaagcgtaccccgccaactacccctatcccctgattggggccaccgccgtacccagcctgacgcagaaaaagttcctctgtgaccgggtgatgtggaggatacccttctctagcaacttcatgtctatgggctccctcaccgacctggggcagaacatgctgtacgccaactccgctcacgccttggacatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaa

SEQ ID NO: 221 - DNA, 34 bp, Artificial Sequence
  loxP site
ataacttcgtatagcatacattatacgaagttat

SEQ ID NO: 222 - DNA, 34 bp, Artificial Sequence
  FRT site
gaagttcctatactttctagagaataggaacttc

SEQ ID NO: 223 - DNA, 1023 bp, Artificial Sequence
  SB100X (Sleeping Beauty) transposase
atgggaaaatcaaaagaaatcagccaagacctcagaaaaagaattgtagacctccacaagtctggttcatccttgggagcaatttccaaacgcctggcggtaccacgttcatctgtacaaacaatagtacgcaagtataaacaccatgggaccacgcagccgtcataccgctcaggaaggagacgcgttctgtctcctagagatgaacgtactttggtgcgaaaagtgcaaatcaatcccagaacagcggcaaaggaccttgtgaagatgctggaggaaacaggcacaaaagtatctatatccacagtaaaacgagtcctatatcgacataacctgaaaggccactcagcaaggaagaagccactgctccaaaaccgacataagaaagccagactacggtttgcaactgcacatggggacaaagatcgtactttttggagaaatgtcctctggtctgatgaaacaaaaatagaactgtttggccataatgaccatcgttatgtttggaggaagaagggggaggcttgcaagccgaagaacaccatcccaaccgtgaagcacgggggtggcagcatcatgttgtgggggtgctttgctgcaggagggactggtgcacttcacaaaatagatggcatcatggacgcggtgcagtatgtggatatattgaagcaacatctcaagacatcagtcaggaagttaaagcttggtcgcaaatgggtcttccaacacgacaatgaccccaagcatacttccaaagttgtggcaaaatggcttaaggacaacaaagtcaaggtattggagtggccatcacaaagccctgacctcaatcctatagaaaatttgtgggcagaactgaaaaagcgtgtgcgagcaaggaggcctacaaacctgactcagttacaccagctctgtcaggaggaatgggccaaaattcacccaaattattgtgggaagcttgtggaaggctacccgaaacgtttgacccaagttaaacaatttaaaggcaatgctaccaaatactag

SEQ ID NO: 224 - DNA, 228 bp, Artificial Sequence
  Sleeping Beauty Left inverted repeat (LIR)
cttagtgtatgtaaacttctgacccactggaattgtgatacagtgaattataagtgaaataatctgtctgtaaacaattgttggaaaaatgacttgtgtcatgcacaaagtagatgtcctaactgacttgccaaaactattgtttgttaacaagaaatttgtggagtagttgaaaaacgagttttaatgactccaacttaagtgtatgtaaacttccgacttcaactg

SEQ ID NO: 225 - DNA, 228 bp, Artificial Sequence
  Sleeping Beauty Right inverted repeat (RIR)
cagttgaagtcggaagtttacatacaccttagccaaatacatttaaactcactttttcacaattcctgacatttaatcctagtaaaaattccctgtcttaggtcagttaggatcaccactttattttaagaatgtgaaatatcagaataatagtagagagaatgattcatttcagcttttatttctttcatcacattcccagtgggtcagaagtttacatacactcaa

SEQ ID NO: 226 - DNA, 1785 bp, Artificial Sequence
  piggyBac transposase gene
atgggcagcagcctggacgacgagcacatcctgagcgccctgctgcagagcgacgacgagctggtcggcgaggacagcgacagcgagatcagcgaccacgtgagcgaggacgacgtgcagtccgacaccgaggaggccttcatcgacgaggtgcacgaggtgcagcctaccagcagcggctccgagatcctggacgagcagaacgtgatcgagcagcccggcagctccctggccagcaacaggatcctgaccctgccccagaggaccatcaggggcaagaacaagcactgctggtccacctccaagagcaccaggcggagcagggtgtccgccctgaacatcgtgagaagccagaggggccccaccaggatgtgcaggaacatctacgaccccctgctgtgcttcaagctgttcttcaccgacgagatcatcagcgagatcgtgaagtggaccaacgccgagatcagcctgaagaggcgggagagcatgaccggcgccaccttcagggacaccaacgaggacgagatctacgccttcttcggcatcctggtgatgaccgccgtgaggaaggacaaccacatgagcaccgacgacctgttcgacagatccctgagcatggtgtacgtgagcgtgatgagcagggacagattcgacttcctgatcagatgcctgaggatggacgacaagagcatcaggcccaccctgcgggagaacgacgtgttcacccccgtgagaaagatctgggacctgttcatccaccagtgcatccagaactacacccctggcgcccacctgaccatcgacgagcagctgctgggcttcaggggcaggtgccccttcaggatgtatatccccaacaagcccagcaagtacggcatcaagatcctgatgatgtgcgacagcggcaccaagtacatgatcaacggcatgccctacctgggcaggggcacccagaccaacggcgtgcccctgggcgagtactacgtgaaggagctgtccaagcccgtccacggcagctgcagaaacatcacctgcgacaactggttcaccagcatccccctggccaagaacctgctgcaggagccctacaagctgaccatcgtgggcaccgtgagaagcaacaagagagagatccccgaggtcctgaagaacagcaggtccaggcccgtgggcaccagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacaggtggcccatggccctgctgtacggcatgatcaacatcgcctgcatcaacagcttcatcatctacagccacaacgtgagcagcaagggcgagaaggtgcagagccggaaaaagttcatgcggaacctgtacatgagcctgacctccagcttcatgaggaagaggctggaggcccccaccctgaagagatacctgagggacaacatcagcaacatcctgcccaacgaggtgcccggcaccagcgacgacagcaccgaggagcccgtgatgaagaagaggacctactgcacctactgtcccagcaagatcagaagaaaggccaacgccagctgcaagaagtgtaagaaggtcatctgccgggagcacaacatcgacatgtgccagagctgtttctga

SEQ ID NO: 227 - DNA, 3670 bp, Artificial Sequence
  GLN multicistronic-expression cassette
tagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaacgcgtggtaccgaagccgctagcgctaccggtcgccaccatgcccgccatgaagatcgagtgccgcatcaccggcaccctgaacggcgtggagttcgagctggtgggcggcggagagggcacccccgagcagggccgcatgaccaacaagatgaagagcaccaaaggcgccctgaccttcagcccctacctgctgagccacgtgatgggctacggcttctaccacttcggcacctaccccagcggctacgagaaccccttcctgcacgccatcaacaacggcggctacaccaacacccgcatcgagaagtacgaggacggcggcgtgctgcacgtgagcttcagctaccgctacgaggccggccgcgtgatcggcgacttcaaggtggtgggcaccggcttccccgaggacagcgtgatcttcaccgacaagatcatccgcagcaacgccaccgtggagcacctgcaccccatgggcgataacgtgctggtgggcagcttcgcccgcaccttcagcctgcgcgacggcggctactacagcttcgtggtggacagccacatgcacttcaagagcgccatccaccccagcatcctgcagaacgggggccccatgttcgccttccgccgcgtggaggagctgcacagcaacaccgagctgggcatcgtggagtaccagcacgccttcaagacccccatcgccttcgccagatctcgagctcgaggaagcggagctactaacttcagcctgctgaagcaggctggagacgttgaagaaaaccccgggcccggatccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggaagttcctattctctagaaagtataggaacttccagagccgagggcaggggaagtcttctaacatgcggggacgtggaggaaaatcccgggcccgctatggccacaacctgttacattgcacaagataaaaatatatcatcacgaacagtaaaactgtctgcttacataaacagtaatacaaggggtgttatgggatcggccattgaacaagatggattgcacgcaggttctccggccgcttgggtggagaggctattcggctatgactgggcacaacaggcaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagaagttcctattctctagaaagtataggaacttcctaatgaggccgcgactctagagtcggggcggccggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgg

SEQ ID NO: 228 - DNA, 120 bp, Artificial Sequence
  A12.orf00001 hypothetical protein
atgcatgctcgagcggccgccagtgtgatggatatctgcagaattcgcccttccttaattaacctgcagcgatcgcgtttaaacaagggcgaattccagcacactggcggccgttactag

SEQ ID NO: 229 - DNA, 384 bp, Adenovirus A12
  MISC_FEATURE (1)..(384): A12.orf00003 E4 ORF1 protein
atggctgcttttgagactctttatgtgtattttacgggacctggggctatgttgcctaaacaagagggcgactctaatgcttatgtgttattttctcctgcgaattttgttatacctccacatggagttgtgcttttatatttgcacatagcagttgatattcctcctggatatttgggaacattgttttcattatgcgacatgaacgccagaggggtttttgttggcgctgaaacgctttatccaggctcaagaatggagctcagtgttttgttgtttaatcattccgacgtgttttgcgatgttcgcgcaaagcagccagtcgcgcgcttgcttttaagtagagttgtttttccacccgtttgccaggcatctttaatttaa

SEQ ID NO: 230 - DNA, 267 bp, Adenovirus A12
  MISC_FEATURE (1)..(267): A12.orf00004 E4 ORF2 protein
atgcattatttaactcctcctatgcgcgatgtctacgttggcgccacgcttactaatatgggtccatttgtgcaagttgtatgttctgtgggaactccggaacttgtacctggaggtgaactttctttgctgctggcttctgatttgtatgattttatacaactggcattaagatgtcagctgcgagaccaaggtgtggagcctaatgtaaatctactgaatttactgcaggtgtttgaagatccagacttttttcagcaaatatga

SEQ ID NO: 231 - DNA, 351 bp, Adenovirus A12
  MISC_FEATURE (1)..(351): A12.orf00005 E4 ORF3 protein
atgaagtactgcctgcggatggcggtggagggcgcccttacagagctttttaatattcacggtttaaacctgcaaaatcagtgtgttcaaataatacaacagtggaagaatgaaaattacctgggaatggttcagtcaggcagtttgatgatagaagagtttcatgataatgcatttgctttgcttttgtttatcgaaatcagagctgtggctcttttagaagctgttgttgaacatttggaaaatcgcttacaatttgatctggctgtgatctttcaccagcacagcggaggcgatcgctgccacctgcgagatttacgcattcaaatccttgctgaccgtcttgattaa

SEQ ID NO: 232 - DNA, 876 bp, Adenovirus A12
  MISC_FEATURE (1)..(876): A12.orf00008 E4 control protein 34 kDa
atgcagcgcgacagacggtatcgctacagattggcaccatacaacaagtaccaactaccgccctgtgaggaacagtcaaaagctacgttgagtacttcggaaaattctttatggcctgagtgtaatagtctgactttacataatgtaagtgaggtaagaggcattccttcatgtgtaggttttacagtgctgcaggaatggccaataccgtgggatatgattctaactgattatgagatgtttattttgaaaaaatacatgagtgtatgtatgtgttgtgccactataaatgttgaagttactcaattattacatggtcatgagcggtggcttattcattgtcattgccagcgtccgggttcactacagtgtatgtcagctgggatgcttttgggacgctggttcaaaatggccgtatatggcgccttaattaacaaaaggtgtttttggtatcgggaggttgttaaccatttaatgcctaaagaggtgatgtatgtgggaagcacctttgttagaggtcgccatttaatttactttaaaattatgtatgatggccatgcctggttagcgttagaaaaagttagttttggatggagcgcctttaattatggaattttaaataacatgttagtgctgtgttgtgattattgtaaagacttaagtgagatacgcatgcgctgttgcgctcgtcgtaccagactgctaatgttaaaagttgttcaagtaattgctgaaaacactgttcgccctctaaaacatagtcggcatgaacgttatcgtcagcaactgctaaagggtttaattatgcatcatcgagcaattttatttggagattataatcaacgagagaatccttgggcggctgatggacactga

SEQ ID NO: 233 - DNA, 225 bp, Adenovirus A12
  MISC_FEATURE (1)..(225): A12.orf00009 E4 ORF 6/7 protein
atggacctggttttggatggggaatgccgcttgagtgactgtgcgggcgagggattcgtttccatcaccgaccctcgctttgcccgtaaagaaactgtgtggacgctaacgccaaaaaacctaagtcgaaatattcaagtgcagttgttttcagctacaaagggggaaagggaggtatacaaggtaaaatgggaaggaggcagtttaaccacgcgtatagtgtaa

SEQ ID NO: 234 - DNA, 1764 bp, Adenovirus A12; identical to SEQ ID NO: 129
  MISC_FEATURE (1)..(1764): A12.orf00012 L5 fiber

SEQ ID NO: 235 - DNA, 159 bp, Adenovirus A12
  MISC_FEATURE (1)..(159): A12.orf00013 U protein
atgaagatggtgggtagggattgggaagaagaatctgaccttccatttaagatttggagaaagtttgctgtttgcaagtctgtcaggtttgacagttgggaagagggaaattttataagagtacacggagaccatgatgtattttcagatttccggtaa

SEQ ID NO: 236 - DNA, 387 bp, Adenovirus A12
  MISC_FEATURE (1)..(387): A12.orf00015 E3 14.7 kDa protein
atgattgaacctgatctagaaattgatggaagaatcaccgaacagaggctcctcactgatcgcgctaggcgacgccaacaggatcaaaaaaataaagagttaattgatttacaaaccgtgcatcagtgtaaaaaaggacttttttgcctggtaaaacaagctacccttcgctatgaatctttaccaggcaaagaacatcaactgtgctacacgctgcccactcagcgacaaacctttactgcaatggtgggctcggtacctattaaagtgtcccaacaagcaggagaacaagaaggctctattcggcgcctatgtgataaccctgaatgtttgtacactttaataaaaacactgtgcggtttaagaaatcttttaccaatgaattaa

SEQ ID NO: 237 - DNA, 333 bp, Adenovirus A12
  MISC_FEATURE (1)..(333): A12.orf00017 E3 RID-beta
atgaaaacagcattagttcttttctttatgttaatcccagtttgggctagttcttgtcaactacataaaccatggaattttttagattgttatactaaagaaacaaactacataggctgggtttatggaattatgtctggcttagtatttgtctcctctgtagtttctttacaactgtatgcgcgccttaattttagttggaataagtatactgatgatcttcccgaatatccaaacccccaggatgatttacccctaaatattgtatttccagagcccccgcgtcctccttctgttgttagctattttaagttcaccggtgaagatgattga

SEQ ID NO: 238 - DNA, 276 bp, Adenovirus A12
  MISC_FEATURE (1)..(276): A12.orf00019 E3 RID-alpha
atggtgacggttcttctcatctttttatgcctgccagtcattttttcttcttcgacttttgccgcagtcagtgaccttgatcccgagtgtttagccccctttgcggtgtacctgattttcacatttgtgactgctacctgcgtctgcagtattattactctgctaatcacctcgctccaattttttgattactactacgtgagaattgtttaccgcagacaccacccccgttaccaaaaccctcaaattgcggctcttttgcagctccaaccatga

SEQ ID NO: 239 - DNA, 807 bp, Adenovirus A12
  MISC_FEATURE (1)..(807): A12.orf00020 E3 CR1-beta
atgctttccatttttcttttatttctcttttctttaccttctggcttgtatgctcaaacagccgaaagaccactaaaagtcgtggtggaagctggccataatgtaacccttccccacctttctggttcacaccaaactggccatgttacttggctagtagagacatcagattatggttcagcttctccagacaacttcattttcagtggacaaaaactatgccagtttactgacagaaccatggtgtggccttattacaatttacattttaactgtgaaaattatgaccttaatctgttttggcttaaggtggaaaattcggctatttacaacgttaaaaatacagtcaatgcttctgaaacaaatatttactatgatttaagagtagtacaaatttttccacctaaatgcatcattacttcaaagtaccttacaaacgattattgtcacattacaattaactgcactaactctgattaccccaataaggttgtgtttaataatgtcagtcgatggtactacggatacggtaagggcagcccaacccttcccaactactttataactaactttaatgtttcaggtattactaaaagctttaatcacacttacccttttaatgagctctgtgattatcccacatcccaatctcaacacagtttaacacatacagtaagcacagtaatctttttaggaataattggcttcagcattttgattattatagcagcctttatttatctgtgctggcatagaaaatctttgtgtgtttctaaaacagaacctcttatgccgattccttactag

SEQ ID NO: 240 - DNA, 771 bp, Adenovirus A12
  MISC_FEATURE (1)..(771): A12.orf00021 E3 CR1-alpha
gtgctgaatttaatcatctgtagtggcgctgtaccgcctgaagaagaacctaactgtcatccgcatttaagcaacattaaaatcaacctttcgatccctcatatcactcttcgctgcagttttttttccacacatctcacctggacctttaacggaaaacacgttaccaatacagatataaagtttaaactacacaaagaaaacatcactctatttcaacctattaacctgggatactaccgctgctcagctccaccctgtacgcaagcattttttgttgctccagttattgacaaacgccctgctccgacaacagctgctgtcactgagcacatcaccgaggcagtttctccttctaaaggtacagaggaaattgtgtacttttcaaactttacaaaccacttagttttaaattgttcctgttctaactccttaatttcatggtttgctaacagctctctgtgcaaaactttctaccaaggaaaacttttgtattctgctaaactcacattgtgtaaccagagcaccccttcccaccttactctattgccaccttttgttgccggtcgttacttttgcataggagctgcacgtactagcccctgtcaacagcattggaatttaacttactgtcccccaccagtgtcgccctttgtgatcaatactgaatatttagactataatcccttgcttgcttacggcggtctcgcagctcttattttattcctgatttctaacttgtttctagtgcaacatttgtattcatactaa

SEQ ID NO: 241 - DNA, 318 bp, Adenovirus A12
  MISC_FEATURE (1)..(318): A12.orf00022 E3 12.5 kDa immune modulating protein
atgtctaatggagcggctgacagagcgcggctgcgacatttagaccactgtcgccaacctcactgctttgctcgagacatctgtgtctttacctactttgagcttccagaggagcacccccaggggccagctcacggtgtcagaataacagttgaaaaaggaattgatacacacctcattaaatttttcaccaaacgcccgctattggtggaaaaagatcaaggaaatactatattaactttatattgcatttgtcctgttcccggattacatgaagatttctgctgtcatttgtgtgctgaatttaatcatctgtag

SEQ ID NO: 242 - DNA, 702 bp, Adenovirus A12
  MISC_FEATURE (1)..(702): A12.orf00023 L4 protein VIII
atgagtaaagatattcccacgccttacatgtggagctttcaaccgcaaatgggactggcggccggcgcggctcaagactattctagcaaaatgaattggttaagcgccggaccccacatgatttccagggtgaatggggtacgagcccggcgtaaccaaatactgctagaacaagccgctctcaccgctacaccacgtaatcaacttaaccctccctcttggccagctgccctgatatatcaggaaaatccccctcctaccactgtacttttgcctcgcgacgcccaggccgaagtccatatgactaacgctggggcacagcttgcgggcggtgcacgtcacagtttcaggtataaaggtcgcactgagccctatccgtctccagctataaaaagagtactcatcagagggaaaggtattcagctgaacgacgaagtcacatcgccattgggagtcagacccgacggagtgtttcagctcggagggtccggacgttcctcctttaccgctcgtcaagcctacctgacactacagagctcatcctcagctccgagatctggtggtattggaactctccaatttgtggaggaatttactccatctgtttacttcaatcctttttcgggctcgcctggacactatcctgacgccttcatacccaactttgacgcagtgagtgaatctgtggatggctatgattaa

SEQ ID NO: 243 - DNA, 357 bp, Adenovirus A12
  MISC_FEATURE (1)..(357): A12.orf00026 L4 splicing factor
atgatggagtggcgattccaaggaatgtcctccattactaccgtcatctctacagcccctttgaagagctcgacaaggaaccgacctgcaacagccaagcggcccactagaatcggcaacagcagcaacaaggaaagtcctgaggcgcgcgagttaagaaaacgcatttttcccactttatatgctatttttcagcagagtcgaggtcaagaacacgaactgaaaataaaaaaccgttccctgcgttcacttacccgcagctgtctctacctcaaaagcgaagatcagttgcaacgcaccttgcaggacgcagaagctctgttcaataaatactgctccctctcgcttaaagagtaa

SEQ ID NO: 244 - DNA, 2349 bp, Adenovirus A12
  MISC_FEATURE (1)..(2349): A12.orf00028 L4 hexon-assembly protein
atgatggatctggagccacaggaaagcttaaccgcccccaccgctcccgccattggcgctacggctgtcatggagaaggacaaaagtctactcataccccaagacgcaccggttgagcagaacttgggctacgagactccccccgaggaatttgaaggctttcttcaaatccaaaagcaaccaaatgagcaaaacgctgggctcgaggaccatgactacctaaacgagggagatgtcctgtttaaacatctacagcgacaaagcactatcgttcgcgacgccatatctgatcgctcttcaataccagtttcaattgcagaactatcttgcatctacgaacgcaacctgttctccccacgtgtgccccctaaacggcaagccaacggcacatgcgagccaaatcctcgccttaacttctacccagtttttgcagtgccagaagcactggcaacataccatattttctttaaaaatcacaaaatacccctatcctgtcgagctaaccgcagccgcgcagatgagcttcttgctttaagggctggcgcttccatacctgggattgtgtccttggaagaggtgcctaaaatttttgaaggtttaggtcgggatgaaaaacgagcagcaaatgccctgcaaaaagaaaatgaacaaaatcaccatgggaatagtgctctaatagaactggaaggtgacaatgcccgcctggcagttttaaagcgcaatattgaggttactcactttgcctacccggcagtaaatcttccgccaaaggtaatgagcgcagtgatgaatcagctactaattaagcgagcccaacccattgacaaagatgcaaacttgcaagacccggaggcaacagatgatggaaagccggttgtaagcgacgagcaattaactaagtggttgggaacagacaattccaacgaactacaacagcggcgtaaactcatgatggccgccgtacttgtaactgtggaactcgagtgcatgcatcgttttttctccgacatcaccacattgcgcaaaattgaggaatgtcttcactacactttccgccatggctacgtgcgccaagcctgtaaaatttctaatgtggagctgagcaatctagtttcttacatgggcatcttgcatgaaaaccgattgggacagaacgtgctacactcaacactacgcgatgaagcacgcagagattacgtgcgagactgcatttaccttttcctgttacatacctggcaaactgggatgggtgtttggcagcaatgcttggaagaaaaaaaccttcgagaactaaacaaactgttagacagagcactaaaatccctatggaccggttttgacgaacggacagtagctgcagagctagctgacataattttcccagaaaggttaatgataaccttgcaaaacggcttgcctgactttatgagtcaaagtatgctgcacaattatcgctcttttatattagagcgttctgggatgcttcctagcatgtgttgtgcacttccttcagattttgtgcctatatattttagagagtgcccccctcccctgtggagccactgctacttactacgacttgctaactacctagcttaccactcagaccttatgacagattcaagcggcgaaggcctaatggagtgtcactgccgctgcaatctttgcaccccccaccgttctttggtttgcaatactgaactattaagtgaaagtcaagtcattggtaccttcgaaatgcagggaccgcagtctgacagcaatttcacgacgaacctaagacttacccctgggctttggacttctgcctacctgcgcaaatttgaaccccaagattaccacgcccacagtatcaatttttacgaagaccaatccaaacccccaaaagcgccactaacggcttgcgtcattacgcagggaaaaattctagcccaattgcatgctattaagcaagcgcgcgaagagtttttacttaaaaaaggacacggagtgtaccttgatccccaaaccggcgaggaactaaaccttccatcacctttgtgtgctactgcgtctccccattcgcagcatgtccccgaaagccgcaaaacaggctattgcgcagcaacgctcaaagaaacagcagcaacggcaggaaatctgggaggaagaatcttgggagagtcaggcagaggacgaggtcgaggacttggaagaatgggaggaggaggaggcggacagcctagacgaggatccagaggaggaggaggaaggttccaaggacggagcgaccgccgcaaaaccgtcgctttcaaccaagccctctccaatgaaacccgctgtgagcaaatctcagaaagccagccgtag

SEQ ID NO: 245 - DNA, 1356 bp, Adenovirus A12
  MISC_FEATURE (1)..(1356): A12.orf00032 E2A ssDNA-binding protein
atggccagcaatcagcactcacagagggagcgcaccccagaccgcagcgctcagccgccgccgccaaaaatgggcagatactttctggattccgaaagcgaagaagaactggaagctgtgcctttacctccaaagaaaaaagtcaagaaatctatggctgcgatacctctttccccagagagtgcagaagaagaagaggcagaaccaccaagagcagttttaggagtaatgggtttcagcatgccgcccgtccgcattatgcatcatgcagacggttctcagtcttttcaaaaaatggaaaccaggcaggtacacgttttgaaggcttccgctcaaaacagcgacgaaaatgaaaagaatgttgttgttgttgttcgcaatccggcaagccagcccctagtttcagcttgggaaaaaggcatggaagccatggctatgctaatggaaaagtaccatgtggatcacgacgagcgcgccacctttcgttttttgccggatcagggcagcgtgtacaagaaaatatgcacaacatggctcaacgaagaaaagcgcggtttgcagctgactttttcatcccaaaaaacctttcaggagctcatgggacgctttttgcaaggatatatgcaagcttatgccggtgtccaacagaattcctgggaacccaccggttgctgcgtgtgggagcataagtgtaccgagcgcgaaggggagcttagatgcctgcatggaatggagatggtgcgcaaagagcatttggtggaaatggatgtaaccagcgaaagtgggcaacgagcgttgaaagagaacccctcgaaagccaaggtggcgcaaaaccgctgggggcgtaatgtagttcaaattaaaaacgacgatgcccgctgctgttttcatgatgttggctgcgggaataattctttctccggaaagtcctgcggcttgttttattctgaaggaatgaaggctcaaatagcttttaggcaaattgaagcttttatgctggccgactaccctcacatgcgacatgggcaaaaacgtctccttatgccagtgcgctgcgaatgtttaaacaagcaagatggcctgccacggatggggcgtcaactgtgtaaaatcactccttttaacctcagcaatgtggataacattgatatcaacgaagtaaccgaccctggagcgttagccagtattaagtatccgtgtttgttggtttttcagtgcgcaaatccagtttatcgcaatgcgcgcggcaatgctggccctaattgcgacttcaagatttctgctcctgatgttatgggcgccctgcaacttgtgcgccagctgtggggagaaaattttgacggctcccccccctag

SEQ ID NO: 246 - DNA, 621 bp, Adenovirus A12
  MISC_FEATURE (1)..(621): A12.orf00035 L3 protease protein
atgggttcaagcgaacaggagctgacggccattgttcgagatctaggctgtggaccctattttttgggaacctttgacaaacgttttccgggttttgtgtctcgcgaccgcttatcatgtgctattgttaacactgccggtcgcgaaactgggggcgtacactggctggcttttggatggaaccccaaatcgcacacttgctatttattcgatccatttggattttctgatcaacgactaaaacaaatctatcagtttgagtacgaaagtctgttgcgccgtagtgcgctagcggccactaaagaccgatgcgttaccctagaaaagtcaacccaaactgtacaaggaccgttttctgcagcgtgcggcctgttttgttgtatgttcttacacgcttttactcactggcctgaccatccaatggataaaaatcccactatggacctacttactggggtgcctaattgtatgctacaaagtcctcaggtagtgggcacattgcaacgcaatcagaatgaattgtataaattcttaaacaatctgtccccttactttcgtcacaaccgcgagcgcatagaaaaagctacatcttttactaaaatgcaaaatggactcaaataa

SEQ ID NO: 247 - DNA, 2763 bp, Adenovirus A12; identical to SEQ ID NO: 189
  MISC_FEATURE (1)..(2763): A12.orf00036 L3 hexon

SEQ ID NO: 248 - DNA, 798 bp, Adenovirus A12
  MISC_FEATURE (1)..(798): A12.orf00038 L3 VI capsid protein
atggaagacatcaatttttcgtcgctggccccgcgacacggcacgcggccgtacatgggcacctggaacgagatcggcacgagccagctgaacgggggcgccttcaattggaacagtatctggagcggtcttaaaaattttggttccacgattaagacatatggcaccaaggcgtggaacagccaaaccggccagatgctaagggacaagttaaaagaccaaaattttcaacagaaagttgtagatggtctggcttcgggaattaatggagttgtagacatagccaatcaggctgtacagaaaaaaattgccaaccgtttagagccgcggcccgacgaggtaatggtagaggaaaagctgccacctctagaaactgtgcccggatccgttccaaccaaaggagaaaagcggccacggccggatgcagaggaaaccttagtaacgcacacaacagaaccgccgtcctatgaggaagcaataaaacaaggagccgctctgtcacctaccacctatcccatgaccaagcctattttacccatggctactagagtgtatggaaaaaacgaaaatgtgcctatgacccttgagctgcctcctttgccagaacccactatcgcggatcccgtaggttccgttcctgttgcatctgttccagttgcatcgacagtgagccgtccagcagtgcggcctgttgccgtggctagcttgcgaaacccacgatccagtaattggcaaagtaccctaaacagtattgtgggactgggagtaaagtctctcaaacgccgacgctgctactaa

SEQ ID NO: 249 - DNA, 219 bp, Adenovirus A12
  MISC_FEATURE (1)..(219): A12.orf00040 L2 X core protein
atggctcttacttgccgaatgcgcatacccattccaggatacagaggacgaccccgccggaggaaagggctgaccgggaacggtcgatttcggcggcgtagtatgcgcagacgcatgaagggtggggtgctgcccttcctaattccacttattgctgcggccattggagccgttcccggaattgcctcagtagccttgcaggcttctcgaaaaaattaa

SEQ ID NO: 250 - DNA, 1047 bp, Adenovirus A12
  MISC_FEATURE (1)..(1047): A12.orf00041 L2 protein V
atgcccagcatgaccaaacgcaagttcaaagaagagctgctgcaggccttagcgcctgaaatatatggcccatcggataaccttaccaagcgcgatatcaagcatgttaaaaaacgggaaaaaaaagaggaagaagtcgccgcggcgtcagcagacggcgtcgagtttgtgcgctcatttgcgcccagacgtagggtacagtggaagggacggcaagtaaaacgcattttgcgaccgggcaccacagtggttttttctcccggagagcgaacgattatgcgtcccctaaagcgcgagtacgacgaagtgtacgcagacgatgacattttggagcaagcggcacaacagactggggaatttgcatatggaaaaaaagggcgttacggagacaaaattgctattcctttggacgagggaaatccaacacccagtttaaaggctgtcactttgcaacaagtgttgcccgtccttgggccttcggaagaaaagcgtggaattaaaagggaagccatggatgaattgcagcctacaatgcaactgatggtgcctaagcggcaaaagttagaggacgtactagagcacatgaaggtggatcctagcgtacagccagatgtaaaagtacgtccgataaaaaaggtagctccaggattgggagttcaaacagtggacattcaaattcctgtgcaaactgcattgggtgaaactatggaaatccaaacttcgccaataaaaacaacggtgaacgcaagcgtgcaaacagacccttggtacccgccagtgctttcaacaaaaaaaaaaaagcgtcactacagacaaacaagttcgcttttgccagactacgttttacatccttccattgtgcccacgcctgggtaccgtgggacaacttttcagcgccgagccacagcccctagccgtagacgaggtccatcacgccgtagacgtcgacgcaaagccactttagccccagcggcagtacgtcgcgttgtacaaagggggcgcacactaatacttccatccgtgcgttaccaccctagcattctctaa

SEQ ID NO: 251 - DNA, 567 bp, Adenovirus A12
  MISC_FEATURE (1)..(567): A12.orf00042 L2 VII core protein
atgtccattttggtttcgccaagtaacaacacgggctggggactgggtgccgcccgcatgtatggaggagctaaaacaaggtctagccaacatccagtgcgcgtacgcggacattaccgagctccatggggcgcgcatacccgaggacgcactggtcgcaccactgtagacgatgttattgactcggtagtggccgatgctcgcaagtaccgcgcgcccgctgaaacagcagggtctactgttgatgcagtaattgatgaggtagtggcaaacgcgcgggcttatgcaaggcgccgcagacggctgcgtcgccggcgtagaccaaccaccgccatgcgcgcggccagagcgttggttcgacgggccaggcgcattgggcggcgagctatgatgcgggcagccaggcgggctgcaacgcctgccggtcgagcgcggagacgggccgcagctgcggccgcaacagctattgcaaacctagctgctccgcgacgaggaaatgtatactgggtgcgcgactcagtgaccgggacgcgtgtgccagttcgtacgcgtccacctcacccttag

SEQ ID NO: 252 - DNA, 1494 bp, Adenovirus A12; identical to SEQ ID NO: 161
  MISC_FEATURE (1)..(1494): A12.orf00043 L2 penton

SEQ ID NO: 253 - DNA, 1749 bp, Adenovirus A12
  MISC_FEATURE (1)..(1749): A12.orf00044 L1 IIIa capsid protein
atgcagcgaccggcgatcatcgcggagagggctcctaacctggatcccgcggttttggcggccatgcaaagccagccttctggcgttacagcttcagatgactggacagcggccatggatcgtattatggctttaacggcgcgcagtcctgatgcttttcgccagcagccccaagctaaccgcttttcggccattttggaagcagtagtgccgtctcgtactaaccctactcacgagaaagtgttaaccattgtaaatgctttgttggatagcaaagccatccgcaaagatgaggctggtttaatatacaacgctttgcttgagcgcgtggcacgctataacagtaccaatgtgcaggctaacttagaccggatgggtacagatgtaaaggaggcgctggctcaacgagagcgctttcatcgcgatggtaatcttggttcgctagtagcattaaacgcttttttgagtactcagccggctaatgttccgcgtggtcaggaagattatacaaacttcatcagcgccttgcgactaatggttactgaagtgcctcaaagtgaagtgtatcagtctggacccgattacttttttcaaacgtccaggcagggtttgcaaaccgtaaacttaactcaggcttttaaaaatttgcaaggtttgtggggggttcgtgctccagtaggcgatcgttcaactttgtccagtttactaacaccaaactcgcgcctattactgttgctaattgccccctttaccaacaccaacagtttaagtcgagattcatacctgggtcacttagttactttgtaccgcgaagccattggtcaagcgcaggtagacgaacaaacttatcaagaaataaccagtgttagtcgcgcactgggccaggaggacactggcagtttagaggccacacttaactttttactaactaaccgtcgccagcaagtgcctcctcagtacactttaaatgcggaagaagaacgcatattgcgctatgtacagcaatctgtaagtttgtatcttatgcgtgagggtgccacccccagtgccgccttagacatgacagcgcgcaatatggagccgtccttctacgcttccaatcgagctttcattaatcgcttgatggattaccttcaccgcgctgcggccatgaacggggaatactttacaaatgcaattctaaatccgcattggttgccccctcctggattttacactggtgaatttgatttgccggaaggaaatgatggctttttgtgggatgatgttacggacagtctgtttagtcctgcagttattggacaccatggtaaaaaggaagcaggtgatgaaggtcccttgcttgactctcgggcgagttctccattccccagtttaactagtttacccgccagtgttaacagcggtcgtaccaccagaccccgactaacaggtgaaagtgaatacttaaatgaccccatcttgtttccagtgcgcgacaaaaattttcccaacaatggcatagaaagtttggtagataaaatgtctcgctggaaaacatatgcacaagagcggcgagaatgggaggaaagacagccaagaccagttcgccctcctaggcaacgttggcagcgacgcaaaaaaggggcacatgcgggggatgaaggaagcgatgactcagctgacgacagtagtgtattagatttaggagggtcaggaaacccatttgctcatttgcgcccacagggttgcatagggtcattgtattaa

SEQ ID NO: 254 - DNA, 1122 bp, Adenovirus A12
  MISC_FEATURE (1)..(1122): A12.orf00045 L1 52 kDa protein
atgcatcctgtcctgcgacaaatgcgacctcagcccagggcaaccacggcctcagcagcggtggcgctttcgggctctggcgaacaggaagagcctcaatgtcctacattggagttggaagaaggagaaggcatagcccgattgggcgcccactctcctgagcgtcacccaagggtgcagctcgcccgggacagtcgcgtggcatttgtgcctcgtcagaacatgtttcgcgacaacagcggggaggaagctgaggaaatgcgagactgcaggtttagggccggtcgcgagctgcgccgcggatttaatcgcgagcgactgctgcgtgaggaggactttgagccagatgaacattcggggattagttctgcacgggcccatgtatcagcagccaacttagtaacagcatatgaacaaacggttacagaggaacgtaactttcaaaaaagctttaataaccatgtgcgcacactaatagcgcgagaagaagtagccattggtttaatgcatctttgggactttgtagaagcttatgtacataatccagcaagtaaacccctaactgcccagctgttcttaatagttcaacatagtagagacaatgaaacttttagggatgcaatgcttaacatagctgaaccccagggtcggtggttactcgatttaattaacattctgcagagcattgtggttcaggaacgcagtcttagtttggcagacaaggtggccgccattaattactccatgttaagtttgggaaagttttatgctcgtaaaatctacaaaagtccgtatgttcccattgacaaggaagtgaagatagacagcttttatatgcgcatggctttaaaggtactaacattaagcgacgatcttggagtgtaccgcaatgaccgaatccacaaagcagtaagcgccagtcgccgcagagagctaagcgacaaagagcttatgcatagcttacaaagggcgctgacgggagcaggaacagaggacgagtcgttctttgatatgggcgcagacctacggtggcagccaagcgctcgcgctttggaggcagctggagtggcgtctgctgacgtcactggcgatgacgatgacgaagaccagtacgaggactga

SEQ ID NO: 255 - DNA, 135 bp, Artificial Sequence
  A12.orf00046 hypothetical protein
atggaaaaaatgaaagttggtaagcgactcccttccgtggtttggtggaaaagtcacaagggtaccatagcgaggaaccccggttcgaaaccggcaggatccgctatgagcacaagtgaggcgcttgcgcgttga

SEQ ID NO: 256 - DNA, 1881 bp, Artificial Sequence
  A12.orf00047 E2B terminal protein
gtggcaactattgaacgctttttacccctgcgcaatatttggaaccgagcccgcgaatttatgcgagcaacaactaccgctgccggcatcacatggatgtccagatacatatatgaataccaccgcctcatgttggaagatctcgctccaggtgctgcggctacgcttggctggccgttgtatcgcgaacctcctcctcatttccttgtgggctatcaatacctagtgcgcacctgcaatgactatgtttttgactctcgggcttactcacgcttgcgatacacagaaactgtacagccaggcacgcaaactgttaattggtcagtaatgacaaactgcagctacaccattaatgcaggagcttatcaccgctttgtagatgtggatgactttgcaaccacccttacccaaattcaacaggcagtgcttgcggaacgggtagtggcagatttagctttattacaaccgctgcaaggctacggaagcacgcacatggctgatcgcggaaaccgcgaggtagaggtggaaaggttaatgcaagactactacaaagatcttggacgatgtcaaagtgacgtgtggggaatggcagaccgcctgcgaattcaacaagccggacccaaagatgtggtgcttcttaaaaccattcgtgggcttaaaacagcttacttcaattacattattagtagcattgctcagcttcctggtactttagaagaaacaaaacttagcctaccttgtgactgtgactggctagatgcctttcttgaaaggttctccgacccggtggatatgcagacgcttagctccttgcgcggagttcctacgcagcaaataataaaatgcataatcagcgctgtatccctacctaacgcccctcgcaacgcctcatttcccattttacatgaaacagaacttagaggtggagtttttgagttacgaccacgtgaaaacggtcgagcagtaaccgaaactatgcgccgccgtcgcggcgaaatgattgaaagatttgtagacaggctgcccgttcgccggcgtcgaagaagacaacccccaccacctgtggtcgaggaagaaataatggaggtagaagaggaagaacaagaaatagttccgggcgcatttcagcaagaagtgcgcgagacggtggccgagcttattcgtctgttggaagaagaattgacggtggcagctcgcaactcccagtttttcaattttgcagtagacttttacgaagccatggaacgtcttgaagccttaggtgacatcaacgagctgacgcttcgtcggtggattctgtatttcttcgtctcagaacacgttgccaccaccttaaactacctgtttcagcgcttgcgcaactacggcgtgttcgcacggctcgtggaactcaacttggcgcaagtggttatgcgcgctcgggacagcgaaggaggggtagtatacagccgagtctggaacgaaattggactaaacgcattttcacagcttatgagtcggatatctaatgaccttgcagccactattgaacgtgcgggacatggagacctccaggaggaagaaattgatcaattaatggcagaaattgcctaccaagataactcaggcgacgttcaggagattttaagacaggctgcagtaaatgacactgagattgattctgttgaactttctttcaggttcaaaacaacagggccggtagtgtttacacaacgccgacagattcaagatatcaatcgccgggtagtcgcccatgccagtcaacttcgggctcaacaccttcccctgccagagcgtcaggccgacataccgcttcccccgcttcccgcaggacccgaaccgccgcttcctccgggagctcgtccgcgccgccgattttaa

SEQ ID NO: 257 - DNA, 3186 bp, Adenovirus A12
  MISC_FEATURE (1)..(3186): A12.orf00051 E2B DNA polymerase
atgcttttctctctgactgataccatggacagctccaggctgtacgccctgatttcccgtttccgcccctctcgtgctgaaatctggacatgcagctcgaggggcaccgtcaccctctccgttctcgctttcgaggatccaaacggtagtggcaatgcagcagaagaggaagaggacgaacggcagctgccaagtggtattgattttcccatctgctttctggtgcgaggccgccaggtacacctcattcaacagatacagcccgtgcaacgatgcgaacactgcgcacgcttttacaaacatcagcatgaatgctctgtccgccgacgagatttctactttcatcacatcaacagccattcttccaactggtggcaggagatccactttttcccaatcggttcgcatcctcgcactgagcgcctttttattacctatgatgtagaaacctacacctggatgggggcatttggaaagcaacttgtcccatttatgctggtgatgaaactgtctggggatgacaatcttgtcaaacatgccttacaacttgcattagaacttggatgggaccaatgggaaaaagactctactactttctactgcttaaccccagaaaaaatgaaggtcggtcaacagtttcgtacctatagaaaccgcttacaaacctccttagctactgatctttggatgacttttttacaaaaaaatccacacttgtctcaatgggctcaagaagaaaacggactagtcgcgcttgaagatctttcctacgaagatcttaaaagagcccctgcaattaagggtgagccaagatttgtagagttgtatatagtaggacacaatattaatggatttgatgaaattgttcttgccgctcaggtaatcaataaccgcttggacgtccctggaccctttaaaatttctagaaattttattccaagagctggcaaaatattatttaatgatattacttttgcccttcccaatccccactacaaaaagcgaactaacttcctactgtgggaacacggagggtgtgacgaccaagattttaaataccagtatttaaaagtaatggtcagagatacctttgctcttactcatacatctttaagaaaggctgcacaagcgtatgccctgcctgtagaaaaaggatgttgtccgtacaaggcggtaaatcagttttatatgcttggttcttaccgtgcagatgcaaatgggtttcccctggaggagtactggaaggataaggaggaatacctcctaaatcaagaactatggaaaaaaaaaggagaaaaaaattacaatcttatcggggaaacattaaactattgtgccctggatgtacttgtgactgcctcattggtagaaaaactgcgtagctcatacgcccagtttgttactgacgcagtgggtcttgacgcggcacattttaatgtgtttcagcgtcctaccatttcctctaactctcatgcaattttcagacaaattttgtaccgcgccgaaaaaccacagcgcacacatcttgggcccaacatcctggcgccttcacatgagctatatgactacgttcgcgccagcattcgtggcggcaggtgctatcctacttacataggagtactaaaagagcccatatatgtatatgatatttgcggcatgtatgcatcggccctcacacaccccatgccttggggtcctccccttaacccctatgagcgggcattggccgtgcggcaatggcaggtggcgctggaaaattacacttgcaaaattgattattttgacaaaaatctttgtcctggcatttttactatagatgccgaccccccagatgaaaatcagttggatgttcttcctcctttttgttctagaaaaggcggtcgtttagcctggaccaatgaaagcttgcgcggtgaagtagttaccagcgtagatctggttacactgcataatcgcgggtggcgcttacgcttgctatctgacgagcgcaccaccattttccccacctggaaatgcctggcacgcgaatatgtgcaactcaatattgccgcaaaagaacgggccgatagggacaaaaatcaaaccctaagatctatagccaagctgctttccaatgccttgtacggatcttttgctaccaaactagataacaaaaaaatagttttttctgatcaaatggaagaaagcctaatgaaagaaattgcagcggggcgattaaacatcaaatcctcatcgtttatagaaactgacacgttgagtacagaggtaatgcctgcctttgagcgcgtgtactcacccaaccagttggcgctcgtaaacagcgaagcagaagaaagcgatgaagaccaaggacccgcccctttttatagcccaccaccagaaaattgtgaacacgtgacttacacctacaaaccaatcacattcatggacgctgaagaaggagacatgtgtttacacaccttagaaagttctaaccctttaattaacaacgatcggtacccttcccatgtggcttcctttgtacttgcttggactagagcttttgtgtcagagtggtcagaattcctgtacgaggaggaccgcggaataccactgaaggatagaccccttaaatctgtatacggagacactgacagtctttttgtcacagagaaaggacgccgccttatggagtcgcaaggtaagaaacgcatcaaaaagtacggagggaaacttgtttttgatccatcatgtcctgagctgacctggtcagttgaatgtgaaactgtttgtagttattgtggcgcagatgcttattctccagaatctgtttttttggctccaaaactgtacgcccttaaatgccttcagtgtcctcactgcgggagcacctccaaaggaaaaatacgggctaaaggccacgctacagaggctttgtcttatgatcttatgttaaaatgctaccttgccgaagcacagggagaagacacgcgcttcagcaccagccgcctcagtttaaagcgcacactggccagcgctcaaccaggagcgcatccattcaccgtgaccgaaacaaccctgacgcgcacattacgtccctggaaggacaaaaccctcgtccatttggatgctcaccgcctcgttccttacagcaacagccagccaaacccccgcaacgaggaagtttgctggatcgagatggcatag

SEQ ID NO: 258 - DNA, 1053 bp, Adenovirus A12
  MISC_FEATURE (1)..(1053): A12.orf00052 IVa2 maturation protein
atgcctatggccgatggcctaaagccacttaaaaatttcaaatctttacaagagttactttccttaggcggagagcgtctgttaggggaactggccaagcaaaacatccgcgtccgacaaatgatgaatgaagtggctccgcttctccacgaagacggcagctgcacctcgttaaactatcacttgcaacctgtaattggggtaatttatggacccactggctgtgggaagtctcagttgttgcgtaatttgctttctgcccagctggttacacctgctccagaaactgttttttttattgttccgcaagtggacatgattcccccatctgaaattaaatcttgggaaatgcaaatttgtgagggaaattatgtcccaggaccagagggaactattattccacaatctggaacgctgtgtcctaaatttgttaagttgtcctacgatgacctaactctagaccacaactatgatgtttctgatccagaaaacatttttgctcaagccgctgctcgcggtccaattgccataataatggatgagtgtatggaaaatttgggaagtcacaaaggcgtttccaagtttttccatgcctttccttctaaactccatgacaaatttcccaagtgtactggctacaccgttttcgtggttctccacaatatgaatccaagaagagatttggcaggtaacattgccaatctcaaaatacaatcaaaacttcatatcatgtcacctcggatgcatcccacccagcttaaccgttttatcaatacctatactaaaggtcttccattagcaattagcttgttgttaaaagatatatttaatcaccatgcccagcgttgttgctatgactggattatctacaacactaacccggaacatgaagcccttcaatggtcctaccttcatcccaaagatggcctaatgccaatgtaccttaatatacaggctcatctttacaaaatactggaacacattcaccgtgttcttaatgatagggaacggtggtcaagagcttaccatgtcagaaaaaacaagtatcaataa

SEQ ID NO: 259 - DNA, 435 bp, Adenovirus A12
  MISC_FEATURE (1)..(435): A12.orf00053 IX protein
atgaacggaactactcagaacaacgctgcgctttttgatggaggggtttttagcccttatttgacttccaggttaccatattgggccggagtacgtcagaatgtggtaggatctacagtggacggtcgacctgtggcacctgcaaattcatcaacattaacctatgcaactattggaccctcgcctttggataccgccgccgccgctgcagcttccgcggccgcttctacggctcgcagtatggcagctgatttcagcttctacaatcacttggcttcgaatgctgtgacacgcaccgcagttcgagaggacattctgactgttatgcttgccaagcttgaaactctaactgctcagctggaagagctatcgcaaaaggttgaggaattagctgatgctactacccataccccagcccaacctgtaacccaataa

SEQ ID NO: 260 - DNA, 1449 bp, Adenovirus A12
  MISC_FEATURE (1)..(1449): A12.orf00054 E1B large T antigen
atggagcgagaaatcccacctgagttgggattacatgctggattacatgtcaatgcagctgtggagggcatggctgaagaggagggtttgcatttactcgctggcgcggcctttgaccatgccgccgctgccgacgttgcaagaggagaaggaggaggagcggaaccctgcggtggtggagaagtaaacatggaacaacaggtgcaagaaggccatgtacttgactctggcgaagggcctagttgcgcagatgatagagataagcaggaaaaaaaagaaagtttaaaggaagctgctgttcttagtaggctaactgttaatctgatgtcccgcccgcgtttggaaactgtatattggcaggagttgcaggatgaatttcagcggggtgatatgcatttacagtacaaatacagttttgaacaattaaaaacccactggttagagccatgggaggatatggagtgtgctattaaagcttttgctaaattggccttacgtcctgattgtagctacagaattactaaaacagtaaccattacttcatgcgcctatattataggtaacggggcaatagttgaggtagatacaagcgacagagttgcttttagatgtcgaatgcagggtatgggcccaggggtggtgggtttggatggaattacatttataaatgttaggtttgctggagataagtttaaaggcattatgttcgaagctaatacctgtcttgtcttgcatggtgtttactttcttaactttagtaacatttgtgtagagtcttggaataaggtttctgctaggggctgtactttttatggatgttggaagggtttggtgggtagaccaaaaagtaaactgtctgtaaaaaagtgtttgtttgaaaaatgtgtacttgctttaattgtagagggggatgcacatattaggcataatgcagcttcagaaaatgcctgttttgtattattgaagggaatggctattttaaagcataatatggtttgtggggtgtctgatcaaactatgcgacgttttgttacctgtgctgatggaaattgtcataccttaaaaactgttcatattgtgagccacagtagacattgttggcctgtatgtgatcataacatgtttatgcgctgtaccatacatttaggcttaaggcggggtatgtttagaccttcccaatgtaacttcagccactcaaacattatgctggaacctgaagtgttttctagagtgtgtttaaatggggtatttgatttatctgtggaattatgtaaggttataagatataatgatgatactcgacatcgttgccgacagtgtgagtgtggtagcagtcatctagaacttcgtcccattgtgctaaatgtaactgaggagctgagaagtgaccaccttaccctgtcttgcctgcggactgactatgagtcaagtgatgaagacgacaactga

SEQ ID NO: 261 - DNA, 261 bp, Adenovirus A12
  MISC_FEATURE (1)..(261): A12.orf00057 E1A 29.5 kDa protein
gtgaaaaataatattttgttgtttttaggtcctgtttccgataatgagcctgaacctaatagcactttggatggcgatgagcgaccctcacccccgaaactaggaagtgcggttccagaaggagtaataaaacctgtgcctcagcgggtgactgggaggcgtagatgtgctgtggaaagcattttggatttgattcaagaggaagaaagagaacaaacagtgcctgttgatctgtcagtgaaacgccctagatgtaattaa

SEQ ID NO: 262 - DNA, 597 bp, Adenovirus A12
  MISC_FEATURE (1)..(597): A12.orf00058 E1A 29.5 kDa protein
atgagaactgaaatgactcccttggtcctgtcgtatcaggaagctgacgacatattggagcatttggtggacaacttttttaacgaggtacccagtgatgatgatctttatgttccgtctctttacgaactgtatgatcttgatgtggagtctgccggtgaagataataatgaacaggcggtgaatgagttttttcccgaatcgcttattttagctgccagtgaggggttgtttttaccggagcctcctgtactttctcctgtctgtgagcctattgggggcgaatgtatgccacaacggcaccctgaagatatggatttattgtgctacgagatgggctttccctgtagcgattcggaagacgagcaagacgagaacggaatggcgcatgtttctgcatccgcagctgctgctgccgctgatagggaacgtgaggagtttcagttagaccatccagagttgcccggacacaattgtaagtcctgtgagcaccaccggaatagtactggaaatactgacttaatgtgctctttgtgctatctgcgagcctacaacatgttcatttacagtaagtgtgctatgggaggtgggaggtga

SEQ ID NO: 263 - DNA, 120 bp, Artificial Sequence
  A12.orf00059 hypothetical protein
gtggggcgcggcgtgggagccgggcgcgccggatgtgacgttttagacgccattttacacggaaatgatgttttttgggcgttgtttgtgcaaattttgtgttttaggcgcgaaaactga

SEQ ID NO: 264 - DNA, 132 bp, Artificial Sequence
  A18.orf00001 hypothetical protein
atgaggaagttgggcgcggcgtgggagccgggcgcgccggatgtgacgtgtcgtgagaacactgtattgtgccgagtcatatgcggaagtgtattttttcgcgggcttttgggggttttttgtgttgtgtag

SEQ ID NO: 265 - DNA, 384 bp, Adenovirus A18
  MISC_FEATURE (1)..(384): A18.orf00002 E4 ORF1 protein
atggctgctttacaggctctgtatgtgtattttaagggacctggggctatgttgcctgaacaagaaggttattctaacgcttatgtgttattttctcctgcgaattttgttatacctccgcatggagttgtgcttttatatttgcatatagcagttgatattcctcctggatatttgggaacattattttcattgagcgacatgaacgccagaggggtttttgttggcgctgaaacgctttatccaggctcaagaatggagcttagtgttttgctgtttaatcattccgacgtgttttgcgatgttcgcgcaaagcagccagtcgcgcgcttgcttttaagtagagttatttttccacccgttcgccaggcatctttactttaa

SEQ ID NO: 266 - DNA, 336 bp, Adenovirus A18
  MISC_FEATURE (1)..(336): A18.orf00003 E4 ORF2 protein
ttgcatgacttaaattttgaggtggtggcgtttcttaaagacgtgctacctgagttttggctgctggtaatgcattatttaactcctcctatgcgcgatgtctacgttggtgccacgcttactaatatgggcccatttgtgcaagttgtatgttctgtgggaactccggaacttgtacctggaggtgaactttctttgctgctggcttctgatttgcatgattttatacaattggcattaaggtgtcagctgcgagaccaaggtgtggagcctaatgtaaatctactgaatttactgcaggtgtttgaagatccagacttttttcagcaaatatga

SEQ ID NO: 267 - DNA, 351 bp, Adenovirus A18
  MISC_FEATURE (1)..(351): A18.orf00004 E4 ORF3 protein
atgaagtactgcctgcggatggcggtggagggcgcccttacagagctttttaatattcatggtttaaacctgcaaaatcaatgtgttcacataatacaacaatggaagaatgaaaattacctgggaatggttcagtcaggcagtttgatgatagaagagtttcatgataatgcatttgctttgcttttgtttatcgaaatcagagctgtggctcttttagatgctgttgttgaacatttggaaaatcgcttacaatttgatctggctgtgatctttcaccagcacagcggaggcgatcgctgccacctgcgagatttacgcattcaaatccttgctgaccgtcttgattaa

SEQ ID NO: 268 - DNA, 117 bp, Adenovirus A18
  MISC_FEATURE (1)..(117): A18.orf00005 E4 ORF4 protein
atgcgtagcagagtatccacacaggtcgcatgggctaaaccaagccatgctatgcaagcagccgtgtcccgacttacaggaggaggaggaatacaaggcagaggcataaaaacttaa

SEQ ID NO: 269 - DNA, 876 bp, Adenovirus A18
  MISC_FEATURE (1)..(876): A18.orf00008 E4 34 kDa protein
atgcagcgcaacagacggtatccgtacagattggcaccgtacgggaagtacccgttaccaccttgtgaaaaggagatgagagcttctttgtttggacctgagaattcttcagtttctgagtgtaacagtttaaccttacataatgttagtgaggtaaggggcattccttcatctgtatgctttactgtattacaagagctaccagtgccatgggatatgattttaagtaggtatgaaatgtttatattaaagaagtacatgagcgtgtgtatatgctgtgcaaccatagatgtagagagaacccaattattacatggttatgagagatggtttattcattgtcactgtaatcgcccaggttcattacagtgtaaggcagccggttctttgttagcatggtggtttaaaatggtagtgtatgggtctttaattaataaaagatgcttttggtatagagaagtagtgaatcggtttatgccaaaagaggtgctgtatatgggaagcatttttgttagagggaaacacttgatttatattaaaataatgtatgatggtcatgtcggattggtgttagaaaaaatgagttttggatgcagtgcatttagctatggatttttaaataacatgctggtattatgctgtagctattgtaaggatttaagtgagatacgtgtgcgctgctgtgctcgtcgcacccgtttattaatgataaaagctttacaaatcattatgaaaagtacttctcgttccttgaaacatagccgagtagaaattcagcgtcagcgattactaaagggtattattatgcaccaccgacctgtgctgtttgaagaatatggacaacgtgaaaatccttgggctgctgatggacactga

SEQ ID NO: 270 - DNA, 228 bp, Adenovirus A18
  MISC_FEATURE (1)..(228): A18.orf00010 E4 ORF 6/7 protein
atggacctggtactggatggggaaagttacctaagtgactgtgtgggcgaggggtttgtttctatcattgatcatcgctttgctcggaaggaaactatttggactgtgacacctaagaacctaagtagaaacatgcacatgcagctgttttcggctataaagggggaaagggtggtgtataaaataaaatgggaaggaggcggaagtttaacaacgcgcattgtgtaa

SEQ ID NO: 271 - DNA, 1761 bp, Adenovirus A18; identical to SEQ ID NO: 130
  MISC_FEATURE (1)..(1761): A18.orf00013 L5 fiber protein

SEQ ID NO: 272 - DNA, 159 bp, Adenovirus A18
  MISC_FEATURE (1)..(159): A18.orf00014 U protein
atgaagatggtgggtaggggttgggaggaagaatctgatattccatttaaggtttggaggaagtttgctatttgtaaatctgtcaagtatgacagttgggaagagggaaaacttataagagtacacggagaccacgatatattttcagattttcggtaa

SEQ ID NO: 273 - DNA, 387 bp, Adenovirus A18
  MISC_FEATURE (1)..(387): A18.orf00016 E3 14.7 kDa protein
atgattgaagctgatttagaagtcgatggaagaattaccgaacaaagacttctcaccaatcgcgctaggcaacggcagcaggaacaaaaacacaaagagcttcttgatttgcaaaccgtacaccagtgtaaaaaaggacttttttgtttagtaaaacaagctacactcacttatgagttattatcaggcaaagaacaccagttaagctatgtgttgcccattcagcgccaaacctttactgcaatggtgggttctgtacctattaaagtgtcccaacaagcaggagagcaagaaggctttattcgttgcctgtgtgataatcctgaatgtttgtacactttaataaaaacactgtgcggtttaagaaatcttttaccaatgaattaa

SEQ ID NO: 274 - DNA, 333 bp, Adenovirus A18
  MISC_FEATURE (1)..(333): A18.orf00017 E3 RID-beta protein
atgaagttaccgttagccttcctttttttctttgtgccaattagggcaacaccttgtgaattgcacaagccatgggattttttggattgctacaccaaagaaacaagctacataggttggatttatggaataatgactggtttggtttttatttccagtgtaatagctttacaaatgtatccgcgccttgattttgcatggaaacgatacactgatgatcttcccgaataccctaatcctcaagttaatctaccacaaaatattgtgtttccagaacccccacgtcctccttctgttgttagttactttaaactcaccggtggagatgattga

SEQ ID NO: 275 - DNA, 276 bp, Adenovirus A18
  MISC_FEATURE (1)..(276): A18.orf00019 E3 RID-alpha protein
atggtgacggttctcttcatctttttatgcctaccaattatttttgcctcttcaacttttgcatccgtcagtcacatcaatcctgactgtttaactccatttacagtgtatttaatttttgcatttgtaactgctacctgcgtctgcagtcttattaccctgctaattacatccttgcaattttttgattattactacgttcgatttgtttatcgcagacaccacccgcattatcaaaacccccaaattgcagcccttcttcagttgcaaccatga

SEQ ID NO: 276 - DNA, 810 bp, Adenovirus A18
  MISC_FEATURE (1)..(810): A18.orf00020 E3 CR1-beta protein
atgcttcacatcttaattttgttcttttctctaactcccattgtttatgcccaaacagcagagagaccactaaaggttgtggctgaagctggtcataatgtcacacttcctcatttgctgcctggatttaacaaaactggtcatgtaacttggttaatagaaataccagactatggctcagccccttcaaacaaatttgtttttagcggacaaaagctctgtgagtttgccagcaaaaacctaacgtggtcttttccacaattaatttttaaatgtgacaattatgacattaccctattttggcttaaaattgaaaattcggctatttacaatgtaaaaaacacaatagaagccaccgaaagcaatatatactatcagttaacagtaatacaaattaatccgcccaactgtatcatcacttccaaataccttacagaagattattgtcacattacaattaattgtacaaactctcgctatcctaacaaggttatctttaacaatgtcactagatcttattatggttatgctaaaggcagttctacgcttcccaactactttacaaccagctttaatgtttcaggtatcactaaaacatttaagcataactatccttttagtgagctatgtacttatccgtcttccgaaaatttctacaattcaaaagaaacagtaagcaccatagtctttatagtaataattggctttagtgttcttattattctgggtgccctaatttatctttgttggcatcgcaggtttctttatagatctaaatcagaaccttgtgtacaattaaatgcttactag

SEQ ID NO: 277 - DNA, 798 bp, Adenovirus A18
  MISC_FEATURE (1)..(798): A18.orf00021 E3 CR1-alpha protein
atgaagatttttgttgtcatttgtgtactgaatttaataaattgtagtggcgctttgtcacctgaagaggaacctaattgtcgtccgcctctaactaatatcaaagttgtactttcaaccactcacgttacccttcaatgcaagtttttttctacacaactcacttggacctttaatggaaaaaacgtcgccgaggcaaatttaaagtaccatatcaacaaagaaaacattaccttgcattcgcctattcacctgggatattaccgctgctttgccacaccttgtgtgcaagcgttttttctggctccagttatcaaccctcgtcctgcaactactgctcagcctgaaaaaattaccaagttgatttccaccgctattgctactactgctacaaaaggtacagaagaaatcatatacttttcaaactttacaactaatttacttttaaattgctcgtgctctaactcacttatttcgtggttcgctaacaacaccttctgcaaagctttttttcaaggaacaactttgtattcggctaaacttgaactttgtaacaccagcactccttctaaccttactttgttacctccttttgttgccggccgttatttctgcataggagcaggcgggcatccttgtcagcggcattggaaattagtttttcgtccaacgctggttttacctacgtctgctgatcctactctgtccccaacccctaatttttggcttgaatacagcggacttatagcttttactttatttttactttgcaatttattcttaattaatttttactaa

SEQ ID NO: 278 - DNA, 318 bp, Adenovirus A18
  MISC_FEATURE (1)..(318): A18.orf00022 E3 12.5 kDa protein
atgtctaatggaacagctgacacagctcggctgcgacatttagaacattgtcgccgacttcgctgctttgcccgagacgtgtgtgattttgtttactttgagctccccgaggaacatccccagggacccgctcacggtgtaagggtaacagttgataaaggaattgatacccaccttattaagtttttcaccaaacgtccacttttggtggaaaaggaccaaggaaacactgtactaactttgtactgcatttgttcagttcctgaattacatgaagatttttgttgtcatttgtgtactgaatttaataaattgtag

SEQ ID NO: 279 - DNA, 705 bp, Adenovirus A18
  MISC_FEATURE (1)..(705): A18.orf00023 L4 protein VIII
atgagtaaagaaattcccacgccttacatgtggagcttccaaccccaaatgggtttggccgcaggtgcggctcaggactactccagcagaatgaattggctaagcgccggtcctcatatgatttccaaagtaaacggaattcgcgcccagcgtaaccaaattctgctggagcaggcggctctcacggccaccccgcgtcatcaattaaaccctccctcttggccagctgccctggtataccaggaaaatcccccgcctactactgtacttttaccccgcgacgcccaggccgaagttcacatgactaacactggggcgcagctcgcgggcggcgcacgtcacagtttcaggtgtaaaggtcgctcctggccctaccccacttcaggtataaagcgactgctcatcagagggaaaggtatacagctcaacgacgaggcagtcacatcgtcactgggtctcagaccagacggagtatttcagctcggaggatccggtcgctcctcctttactacccgccaagcctacctaacgctgcagagctcctcatccgctcctaggtccggcggcatcggaactctccaatttgtggaggagtttactccatcagtttacttcaaccccttttcgggttctccaggccactacccagacgccttcatccccaacttcgacgcagtgagtgaatctgtggacggctatgattaa

SEQ ID NO: 280 - DNA, 336 bp, Adenovirus A18
  MISC_FEATURE (1)..(336): A18.orf00024 L4 33 kDa protein
atgtcctgcattactaccgtaatctttacagccccttcgaagcgcccaacaaagaagcaacctgcggcgaccaagcggtccattagaaaaagaagcaacaacaacatcgaagaaagtcctgagacgcgcgagctaagaaaacgcatttttcccactctatatgctatttttcagcagagtcgaggtcaagaacacgaactgaaaataaaaaaccggtccctgcgttcgctaacccgcagctgtctttacctgaaaagcgaagaccagttgcagcgcaccttggaagacgcagaagctctgttcaataaatactgcgctctctcgcttaaagactaa

SEQ ID NO: 281 - DNA, 2364 bp, Adenovirus A18
  MISC_FEATURE (1)..(2364): A18.orf00028 L4 100 kDa protein
atgatggaactccaaccacagggaagtttaaccaccccaagcgctcccgccatctgcactactgctgtcatggaaaaggaaaacagcctacccataccccaggacgcaccggtggagcaggacttgggctacgtgacgccccccgaagagtggcatcaaccagactctcttctaaaccaaaatcagccaaatgaggaacaggcagaaagcaatgaacaaaatgccgggttaaagaatgactacctaggcgagggagatgtcctgcttaagcatctgcagcgacaaaccactatcgtacgcgacgctatagccgaccgcttgtccttgccaatttcagtttcagagttaagcagtgcatacgagcggaatttgttttccccacgtgtgcctccaaagcgacaagccaacggcacatgcgaaccaaatccccgccttaacttttatccagtttttgcagtgccagaagcacttgcaacatatcatatttttttcaaaaatcacaagatccccgtgtcctgccgagccaaccgcacccgcgcagatgaactttttactttaaggtccggcgccgccatacctggtattgtatccttagaggaggtacccagaatttttgaaggcttgggacgtgatgaaaaacgagcggcaaataccctgcaaaaacaaaacgaacaaagtcagtacggaactagcgccctggtagagctggaaggtgacaacgctcggttggcggtactgaagcgaaacgttgcagtgacccactttgcctatccggcgctaaatcttccaccaaaggttatgagcgcagtaatgaatcaggtattaattaagcttgccaaaccaattgatgaacaagcaaacttgcaagatactgaaacaacggacgatggaaaaccagctgtaagcgacgaacagctatcaaggtggttggggacaaacgatagtaaggaactagaacatcggcgcaaattaatgatgggcgctgtactaataactacagaacttgagtgcatgcaccgctttttttctaacagtaccatattgcgtaaaattgaggaatgccttcactataccttccgccatggctacgtgcgccaagcttgtaaagtgtccaatgtggaattaagcaatctagtttcttacatgggcattttgcatgagaaccggctcggtcaaaacgtcctccactctacccttagcggcgaagcgcgcagagactatgtgcgcgattgcatttatctgtttctactgcacacctggcaaaccggcatgggggtgtggcagcaatgcttggaagagcgaaacttgcaagaactacataaactccttgacaagtcgctgagatgcctttggacaggctttgatgaaagaacggtagctgccaacctcgccgacattatttttccagaaaggctattgattaccctgcaaaacggactgcctgatttcatgagccaaagcatgctgcacaattttcgctcttttattttggagcgatctggcatgcttcctagcatgtgttgtgcgctgccttcagattttgtacctatttactttaaagaatgtcctcctcccctgtggagccattgctacctactacaactggccaactacctagcctatcactcagaccttatgacagactccagcggtgagggtctaatggagtgtcattgtcgctgtaatctgtgcacccctcaccgttccctggtttgtaacacagaactactgagtgaaagtcaacttataggaacctttgaaatgcaggggccgcagtctgacaacaacaccgcaacaagtttcaggctcaccccagggctatggacttcagcgtatctgcgtaaatttgagcccgaagattaccacgcccatactatacatttttacgaagaccaatccagacccccaaaggctccgttaacagcttgcgtcattacgcagggaaagattttagcccaattgcaagctattaagcaagcgcgcgaagagtttttacttaaaaaaggacacggagtgtaccttgacccccaaaccggcgaggaactcaatcttccatcaccttcctgtgctaccacgtactcttcacatccacagcatgcccccgaaagccgccaaacaggccattgctctacaacgttcaaagaaacagcagcaacagcaggaaatctgggaggaagaatcttgggagagtcaggcagaggaggacgaggacttggaagaatgggaggaggaggaggaatacaacagcctagaagaggaggaggaaggtatcgaggacggagcgaccgccacaaaaccgtcgctttcaaccgaggcctccccaccgaaccccacagtgagcaaatctcaaaaagccagccgtag

SEQ ID NO: 282 - DNA, 1461 bp, Adenovirus A18
  MISC_FEATURE (1)..(1461): A18.orf00031 E2A DNA binding protein
atggccagcaatcaacactcacagagggagcgcaccccagatcgcagtgttcagccgccgcctccaaaaatgggccgttactttttggattccgaaagcgaggaagacatgggagctcctgcgcctctgccttcaaaacgaaagatgaagtccgcaaagcctcttcctccgtcgccagagattgttttagacagcgaagaagaggaaggagtagtggaaacgccaaaggcagtcttaggaataatgggattcagcatgccccctgttcgcattatacctcatgcagacgggtcgcagtcttatcaaaaaatggaggtcaacaaacgaaaccccgcaaatgccgcaatgcaaataagcagtgaagaaagttttgttgtccgaaatcctgcgaacgagcccctagtaacggcttgggagaagggtatggaagccatggctatgcttatggagaagtaccatgtggatcatgacgagcgttccaactttagatttttgccagaacagagtggcatatacaaaaaaatatgcgcaacctggattggcgaagaaaagcgcggattgcagctaactttttcatcccaaaaaacgttccaggagctaatgggccgcttcttgcaaggatacatgcaagcatatgccggcgtacaacataaaacctgggaacccaccggttgctgtgtgtgggagcatcagtgcaccgagcgggagggagagcttaggtgtttgcatggcatagaaatggtgcgtaaagagcacctggtagaaatggatgtaaccagtgaaaatggccagcgggcgttgaaagagaatccgtctaaagctaaggtggtacaaaatcgctggggtcgcaatgtagtgcaaattaaaaacgatgacgctcgctgctgtttccatgatgtcggctgcggaagcaactctttttccggaaagtcctgtggcttgtttttctctgaggggtcaaaggcccaaatggcttttaaacagatcgaagcctttatgttggccgactaccctcacatgcgacaggggcagaaacgcgttcttatgccagtgcgttgcgagtgtttaagcaagcaagatggtgtaccacggatggggcgacaactctgcaagatgacgccgtttacccttagcaatgtagaaaacattgacactggcgaagtaaccgacccaggggcgttagccagcattcactatccttgcttgctggtttttcagtgtgcaaatcccgtttaccgcaacacccgcggtaatgccgggcccaattgcgacttcaagatatctgctcctgatgttatgggcgccttgcaacttgcgcgccagctgtggagagaaaattttgaaggcccgcttcctaggcttgttattccagaattcaagtggcacccgcgtctgcagtacaggaatctatccctacctactaatcatggcgactttcgcgaagaaccgtttgatttttaa

SEQ ID NO: 283 - DNA, 615 bp, Adenovirus A18
  MISC_FEATURE (1)..(615): A18.orf00032 L3 protease protein
atgggttcaagcgagcaggagctcacggccattgttcgagacctaggttgcgggccctattttatgggtacatttgacaaacgctttccaggttttatatcccgcgaccgcttatcctgtgctattgttaacactgctggtcgcgaaactgggggcgtgcattggcttgcttttggatggaaccccaaatctcatacatgctatttatttgaaccatttggattttctgacaagcgtctaaaacaaatatatcactttgagtacgagggactgttgcgccgcagcgcactagcagccactaaggaccgttgcgttaccctacaaaaatcaactcaaagcgttcaaggaccattttctgcagcttgtggccttttttgctgtatgtttttacatgcttttactcattggcctgaccacccaatggataaaaatccaactatggacctacttactggagttcctaactgtatgttacaaagtcctcaggtagtaggcatactgcagcgcaaccaggaggagttgtatagatttttaaacaccctatccccttactttcgtcacaaccgcgagcgcatagaaaaggctacgtcttttactaaaatgcaaatgaactga

SEQ ID NO: 284 - DNA, 2760 bp, Adenovirus A18; identical to SEQ ID NO: 190
  MISC_FEATURE (1)..(2760): A18.orf00033 L3 hexon protein

SEQ ID NO: 285 - DNA, 783 bp, Adenovirus A18
  MISC_FEATURE (1)..(783): A18.orf00034 L3 protein VI
atggaagacatcaatttttcgtcgctggccccgcggcacggcacgcgtccgtacatgggtacctggaacgaaatcggcaccagtcagctgaacgggggcgccttcaattggaacagtatttggagcggtcttaaaaattttggctccacaattaaatcatatggcaccaaagcgtggaacagccaaaccggtcagatgctaagggataagctaaaagaccaaaacttccaacaaaaagtggtagatggtctggcttcgggaatcaatggagttgtagacatagccaatcaggctgtacaaaaacagattgcaaaccgcttagagccgcggcccgacgaagtaatggtggaggaaaagctaccccctttacaaacggtgcccgcatccgttccatccaaaggagaaaagcgcccacggccggatgcagaggaaaccctagtaacgcacacagtagagccgccgtcatatgaggaagcagtaaaacagggagcctcagtgttgcccaccacgtaccctatgacaaaaccgattttacccatggctaccagggtgtatggaaaaaatgaacatgcgcctatgactttggaaatcccgcctctgccggaacccactattgccgagccagtgctttcgacaccaccagttgcaacagtgacgcgtccagaagtacggccagtggctgtggccagcttacgaaacccgcgatccagtaactggcaaagcacgctgaacagcattgtggggttgggagtgaaatctctcaaacgccgtcgctgctattaa

SEQ ID NO: 286 - DNA, 219 bp, Artificial Sequence
  A18.orf00035 hypothetical protein
atggctcttacttgccgaatgcgcatacccataccaggatacagaggaagaccccgccggaggagagggctggccggtaacggtcgatttcggcggcgtagcatgcgcagacgcatgaagggcggggttctacccctcctaatccctcttattgctgcggccattggggccgttcccggaattgcttcagtggccttgcaggcttctcgaaaaaattaa

SEQ ID NO: 287 - DNA, 1050 bp, Adenovirus A18
  MISC_FEATURE (1)..(1050): A18.orf00038 L2 protein V
atgaccaaacgcaagtttaaagaagagctgctgcaggccattgcgcctgaaatatatggcccatcggaagctaacaataccaaacgtgaaatcaagcatgtaacaaaacgagaaaaaaaagaggaagaagctgcagcgctagcagacggcgtggagttcgttcgctcctttgcacccagacgtagggtacagtggaaggggcggcgcgtaaagcgcattttgcggccgggaaccacagtggttttttctcccggagagcgggcggttatgcgaccgctaaagcgcgagtacgacgaagtgtatgccgaccatgacattctggaacaagcggcgcagcagactggggagtttgcctatggaaaaaaagggcgctatggagacaaaattgccatccctttggacgatggcaatccaacacccagtttaaaggccgttactctacagcaagtattgccagtgcttgggccttcggaagaaaagcgtggaattaaaagggaagccgcggatgaattgcaacccaccatgcaactgatggtgcctaagaaacaaaaactagaggatgtactagagcacatagaagtggaccctagcatacagccagatgtcaaaatacgtcctataaaaaaagttgctcccggtttgggagttcaaacagtggacattcaaattcctgtgaaaaccgcgtttggtgaacctatggaaacccaaacttcgccaatggaaacccaaacttcgccaataaaaacagtagcggacgctagcatgcagacagatccttattacctacctaggctttccaaaaaacgttactacagaaaagcaagtgcgcttttaccaaactacgttctacatccttcaatcgtgcccacacctggatatcgcgggtccacttttaaacgccgagctgcgggctccagccgcaggcagggcccatcccgccgcagacgccgacgcaaagctaatttagttccagctgcagtgcgccgcgttgtacgaagggggcgcacactggttcttccgtccgtgcgttaccaccctagcattctctaa

SEQ ID NO: 288 - DNA, 570 bp, Adenovirus A18
  MISC_FEATURE (1)..(570): A18.orf00040 L2 protein VII
atgtcaattttgatttcgccaagtaataacacagggtggggcttaggttccactcgaatgtatggaggcgccaaaacaaggtccagccaacatccagtgcgcgtgcgcggtcattatcgagcgccttggggagcacatactcgaggacgcacagggcgcactactgtagacgatgttatcgattccgtagtggcagacgcgcgcaaataccgcagacccgctacctccgccgggtctaccgttgatgcagtcattgacgaggtggttgccaacgctcgagattatgctagacgccgcagacgtcttcgccaccgccgtcgtagaccaaccgctgctatgcgcgccgccagagctttggttcgacgcgccagacgcgttgggcgccgagctatgctgcgggcggcaagacgggctgccacacctactggtcgagcacgcaggcgtgccgcagctgcggcggcaagtgctattgcaaacttagctgctcctcggcgaggaaatgtatattgggtgcgcgactcagtaaccggaatgcgcgtaccagttcgtacgcgtccaccacatccttag

SEQ ID NO: 289 - DNA, 1524 bp, Adenovirus A18; identical to SEQ ID NO: 162
  MISC_FEATURE (1)..(1524): A18.orf00041 L2 penton protein

SEQ ID NO: 290 - DNA, 1737 bp, Adenovirus A18
  MISC_FEATURE (1)..(1737): A18.orf00043 L1 protein IIIa
atgcagcgaccggcgatcaccacggacgggacccctaacctggatcccgcggtcatggcagccatgcaaagccagccttctggggttacagcttcagatgactggacagcggccatggatcgtatcatggctttaacggcgcgcagtcctgaggcttttcgccaacagccccaagcaaatcgattttcggccattttagaagcagtagtgccttctcgcactaaccctacacatgaaaaagtgttaaccattgtgaatgccttgctggatagcaaagctatccgcaaagatgaagcgggtttaatatacaacgctttgttagagcgggtggcgcgctacaatagtactaacgttcaggcaaacttagatcggatgggaactgatgtcaaggaggcgttggcaaaaagagagcgctttcatcgcgacggtaatcttggctcgctggtggcgctaaatgcttttttgagtactttgccagccaacgttccgcgcggccaagaggattacacaaactttattagcgcactgcggctcatggtcaccgaggtaccgcaaagcgaagtgtaccagtccgggcccgattatttttttcaaacttccaggcagggtttgcaaactgttaatttaacgcaggcttttaaaaatttgcaaggcttgtggggagtccgtgctcctgtgggagaccgctcaaccgtgtccagtttgttaacgccaaactcacgcttattgctgttgctgattgccccctttaccaatagcggtagtttaagtcaagattcataccttggtcacctaattactttgtaccgcgaagccattggtcaagcgcaggtagatgaacagacatatcaagaaataactagtgttagccgagcgctgggtcaggaggacactggcagtttagaggcaacattaaactttctcctaaccaaccgtcgtcaacaagtgcctccgcagtatagtttaaatgcagaagaagagcgtatattacgctatgtacagcaatcggtaagcttgtatcttatgcgagagggcgccacgcccagcactgctttagatatgactgcgcgaaatatggagccgtctttctatgcttccaatcgagcattcattaatcgccttatggattaccttcaccgcgcagcggccatgaacggcgaatactttaccaatgctattttaaatccacactggcttccccctcctggcttttatactggcgagtttgatttacccgaaggaaatgatggctttttgtgggatgatgttacagacagtttgtttagtccagcagccattagtcaccatggcaaaaaggaagggggagatgaaggtccgctgattagttctcgatcaagttctccgtttcctagcttaacaagtattaacagtggacgggacaccaggccgcgactaactggggaaagcgattacttaaacgaccctatgctgcttccagtacgggacaaaaactttcctaacaatggtattgagaggctggtagacaaaatggcccgttggaaaacatacgcgcaggaacgccgagaatgggaggagaaacaaccaaagcctgttccgcctcccaggcaacgctggcagcgccgcaggaaaggagcatatgcttctgaaccagaaagcgacgattctgccgatgatagcagtgtgctggatttaggcggcacagggaacccatttgctcacttgcgtccccagggttacataggtcctctgtattaa

SEQ ID NO: 291 - DNA, 1125 bp, Adenovirus A18
  MISC_FEATURE (1)..(1125): A18.orf00045 L1 52 kDa protein
atgcatccagttctgcgacaaatgcgaccccagcccagggtaactacggcctcagcagcggtgccgctttcgggccctggcgaacaggaagagcctcagccttccacgttggagttagaagaaggagaaggcatagcccgattgggcgcccattctcctgagcgacacccacgggtgcagctaactcgagacagccgcgcggcgtttgtgcctcgtcaaaacatgtttcgagacaacagcggggaggaagctgaggaaatgagagactgcaggtttagggccggtcgcgagctgcgccgcggatttaatcgcgagcacctgctgcgcgaggaagactttgaaccaaatgagcgttcgggcattagtccagcacgggcccacgtcaccgcagccaatctagtaacagcgtatgaacaaactgttacagaggaacgtaattttcaaaagagttttaataatcatgtgcgcacactaatagcgcgagaagaagtggcaattggtttaatgcatctgtgggactttgtagaagcttatgtacataatccagcaagtaaaccccttactgcccaactgttcttgattgttcaacatagtagagataatgaaacttttagggacgcaatgctaaacatagctgaaccacagggtcgttggttacttgatttaattaacattctccaaagcattgtagtgcaggaacgcagtcttagtttagctgacaaggtggctgcggttaattactccatgttaagtcttggaaagttttacgcccgcaagatttataaaagtccgtatgttccgatcgacaaggaagtaaaaatagacagtttttatatgcgcatggctttaaaggtactaacattaagcgatgatcttggagtgtatcgcaatgacaaaatccacaaagcagtgagtgccagtcgccgcaaggagctgagcgacaaagaactaatgcatagcttgcaaagggcgctcacgggcgcgggaacagaggaggaggagtcgttttttgatatgggagcagacctccggtggcagcccagcgctcgtgctctggaggcggtcggagcaacaaccgctgatgtcaccgacgagtatgatgacgaagaccagtatgaggactga

SEQ ID NO: 292 - DNA, 1884 bp, Adenovirus A18
  MISC_FEATURE (1)..(1884): A18.orf00047 E2B terminal protein
atggctacaattcaacgctttttacccctgcgcaacatttggaacagagctcgcgagttcgctcgggcaaccaccaccgccgccggaatcacatggatgtctcgatacatatatgaataccaccgccttatgctggaagaccttgctcctggtgctccggccactttgcgttggccgttatattatgaacctccccctcatcttctggtaggctaccagtatctagtccgtgtctgcaatgactatgtgtttgactcccgtgcgtactcgcgcttacgctacacagaaactgttcagccaggttcgcaaactgttaactggtcggtaatgacaaactgcagctacactattaatacgggagcatatcacaggtttgtggacttggatgactttgccaccaccctagctcaaatccaacaggccgtacttgccgaacgcgtggtggccgatcttgccttgttgcaaccgttacaaggatatggcagcacacgtatggctgaccgcgaacagcgcgaagtagatgtggaaaggttgatgcatgactactacaaggaccttggacggtgtcaaagcgaagtttggggaatggctgaccgtctgcggatccaacaagccggtccaaaagacgcagtgcttcttacaaccattcgtcgtcttaagtcggcctactttaattacatcattagcagcattggagaccattctgattctgcaaatcaaacaaaactcagcctaccttgtgactgcgattggctagatgccttccttgaaaaattttctgatccggtggatatggacacactcagctccttgcgcggagttcctacgcaacaaatcataaaatgcatagtaagtgctgtgtcattgcccaacaccccttccaatgcttccatccctactttcagtgggacaggatttagaggtggagcatttgagttacgtccccgcgaaaacggtcaagctgtaaccgaaaccatgcgccgtcgccgcggcgaaattattgaaagatttgttgaccgattgccaatacgccgtcgacagagacgtgcgcccccacctccgccggaagaagaagaaataatggaaatacaagaggaggaggaggaggaggaggcgccatgggcatttgaacgggaagttcgcgaaacagtagccgagctcattcgtcttctagaacaggagttaacggtggcggctcgcaactcccagtttttcagctttgcggtggacttctacgaggccatggaccgtcttgaggccctaggagacatcaacgagctaacgctgcgccgctggattctttatttctttgtctcggaacatattgccaccaccttgaactacctgtttcaacgcttgcgcaactacggcgtgtttgcacgactagtagaattaaacctggcacaggtggtgatgcgcgcccgagatagcgatggaggagtggtatacagccgcgtctggaacgaaattggactaaacgcattctcacagcttatgagtcgcatatctaacgatcttgccgccaccattgaacgggcgggacatggcgacctccaggacgaagaaattgatcaattaatggcagaaattgcctaccaagataactcaggcgacgttcaggaaattcttagacaggctgcagtaaatgataccgaaattgattctgttgaactttctttcaggttcaagacaacagggccagtagtgtttacacaacgccgccaaattcaagacatcaatcgccgggtagttgcccgggccagtcaacttcgtgctcaacatcttcccctgccagagcgacaagccgacataccccttcctcagctttacgcaggacccgaaccacctcttcctccgggagcccgaccacgccgccgattttaa

SEQ ID NO: 293 - DNA, 3330 bp, Adenovirus A18
  MISC_FEATURE (1)..(3330): A18.orf00050 E2B DNA polymerase
gtgcttagtccccgggcccatggaatactacatgcaatcaattctgccaccggcactccccttgaaatcaagtatcacctgcaccttcaacctgctcttacccgcctgtgtgcagttaacttgaaagctgtccccgcagacttgcttttctctcttggcgataccatggacagcgccaagctgcacgccctggtttctcatctccgccccactcgtgctgagatctggacgtgcggctctcggggcaccgtcaccctttccgtcctcgctttccagaatccaggcggtagtgacaatgcacaagaagagaaagaggacgaacggcacccgccaaaacaaggggtcgattttcccctctgctttttggcgcgaggtcgccgagtacacctcattcagcagatacaacccgtgcaacgatgcgaacactgcggtcgcttttataaacatcagcatgaatgctctgtccgccgccgagatttctactttcaccacatcaacagccattcttccaattggtggcaggagatccaatttttcccgatcggctcgcatcctcgcactgagcgtctttttattacctatgatgtagaaacctatacctggatgggggcatttggaaagcagcttgtcccatttatgcttgtcatgaaattaactggggatgagtgtcttgtaaaccaggggttacaacttgctttggaacttggatgggaccagtgggaaaaagaccccactactttttattgcataaaccccgaaaaaactaaagtgggacaacagtttcgaacctacagaaaccgcttgcaaacatccttagccaatgatatttggtcacattttttacaaaaaaatccccacttgcctcattgggctcaacaggaacacggactaaccgctcttgaggaccttgcctacgaagaccttaaaaaagctccagcaattaagggtcagccaaggttcgtagaattatacattgtaggacacaacattaatggatttgatgaaattgttctggccgcacaggtcattaacagccgctcagacgttcctggaccctttaaaatttctagaaatttcatgccaagagctggcaaaatcttatttaatgatatcaccttcgctcttcctaatccacactataaaaaacgaatagacttttcactgtgggaacaaggaggttgtaatgaccaagactttaaatatcagtatttgaaagtaatggttagagacacatttgctcttactcatacatcattaagaaaagctgcgcaagcatatgccctttctgtagaaaaaggatgttgtccctacaaagctataaatgaattttatatgcttggttcttaccgtgcaaatgcagacggttttcccgtggaagagtattggaaggacaaggaagaatacctcctaaaccaacaactatggaaaacaaagaaagaaaaaaattacaaccttattaaggaaacattaaactattgtgccctggatgtacttgttacagccgcactggtagaaaaactgtacaactcctatgcccactttattactaactctgtgggccttcatgcggcacactttaatgtatttcagcgacctaccatttcctctaactctcatgcaatttttaggcaaattctatatcgctccgaaaaaccacagcggacaaaccttggacccaacatcctggcgccgtcacatgaattatatgactatgttcgcgccagcatccgcggcggtaggtgttatcctacctacataggagtattaaaacaacccatatatgtatatgatatttgtggcatgtatgcatcagcactaacacaccctatgccttggggtccaccccttaacccctatgaacgcgcattggccgcgcggcaatggcacatggcgctggaaaactatacttgtaagattgactattttgataaaaatctttgtccaggtatttttactgtagatgctgatcctccagatgaaaatcaactagatattctccctccatattgttcacgaaaaggcggtcgcctagtgtggaccaatgagcgcttgcggggggaagtagttactagtgtagacataatcacactgcacaaccgtggatggcgagtgcgcctccttcctgacgaacgcaccaccatctttcctacctggaagtgcctggcacgtgaatatgtgcaacttaatatcgctgcaaaggaacgcgcagataaggacaagaatcaaaccctacgctccatagccaaactgctttcaaatgccctgtatggatcttttgccaccaaacttgacaataaaaaaattgttttttctgatcaaatggaagaaggacttatgaaggaaattacagcaggtcgcttaaacatcaaatcctcatcatttatagaaactgacaccttgagtacagatgtaatgcctgcttttgagcgcgtgtacttaccccaacagctggcgctcgtaaacagcgatgcagaagaaagcgatgaagatcaaggacccgcccccttttatagccccccaccagaaacctcaggtcatgtgacttacacctacaagccaatcacatttctggatgctgaagaaggggatatgtgcttacacaccctagaaagctctaatcccttaataagtaacgaccggtatccttcccatgttgcttcctttgtactcgcttggactagggcttttgtgtcagagtggtcagaattcctgtacgaagaagaccgcggaatacccctgaaggacagacctcttaaatccgtgtacggagacacagacagcctttttgtgacagaggaaggacgccgccttatggagtcacaaggtaggaaacgcatcaaaaagcacggtggaaaacttgtttttgatccatcttgtcctgagctgacctggtcagttgaatgtgaaactgtttgtaacttctgcggctctgatgcatactctccagaatctgtgtttttggctccaaaactatacgcccttaaatgccttcagtgtcccagctgcaaacgcatctcaaaaggaaaaatacgagctaaaggacatgccgcagatgctctgtcttatgatctcatgttaaaatgctaccttgccgaagcacagggagaagacgcccagttcagtaccagccgtctgagtttgaagcgcacattggccagcgcacaaccaggagcgcatccatttacagtgacggaaacaactctcaagcgcaccttgcgaccctggaaagacaaaactctcgcccacctagacgctcatcgtctcatcccttacagcaacagccaacccaacccccgcaacgaggaaatttgctggatcgagatgccatag

SEQ ID NO: 294 - DNA, 1050 bp, Adenovirus A18
  MISC_FEATURE (1)..(1050): A18.orf00052 IVa2 protein
atgcctatggctgatggtttaaaacctcttaaaaattttaaatctttacaggagttgctatcgctgggcggagagcgtcttttgggggaactagctaagcaaaacacatgcgtcagacaaatgatgaatgaggtggccccactcctccgagaagacggcagctgcacctcgttaaactatcatttacaaccagttattggggttatttacggacctactggttgcggtaaatcgcagctattgcgtaacttgctttcggcccagctggttacacctgctccagaaactgttttttttattgctccccaggttgatatgattcccccgtctgaaattaaagcttgggaaatgcaaatttgtgaagggaattatgccccaggaccccaaggaactttaataccccaatctggaacattgcgccctaaatttgttaagctgtcctacgatgacttaactctggaccacaactatgatgtttctgatccaaaaaacatttttgctcaggcggccgctgtagggccaattgccataataatggacgagtgcatggaaaatttgggcagccacaaagccgtttctaagttcttccatgccttcccttccaaactacatgataaatttcctaaatgtaccggatacacagttttagtggttttacataacatgaatcccagaagagatttggccggtaacattgctaatcttaaaatacaatcaaaaatgcacatcatgtctccacgtatgcaccccacccagcttaatcgctttataaatacctacactaaagggcttccgctagcaattagcttattacttaaggacatatttcaccaccatgcccagcgttcttgctatgattggattatttataacaccaccccagaacatgaagccctacagtggtgctaccttcaccctaaagacggtcttatgccaatgtatcttaatatacaatcgcatctctatagcatactagaacacattcatcgtgttattagtgacagggaaagatggaccagagcctatcatgtaagaaaaaacaaacactaa

SEQ ID NO: 295 - DNA, 438 bp, Adenovirus A18
  MISC_FEATURE (1)..(438): A18.orf00053 IX protein
atgaatggaactacgcaagacaacgctgcgctttttgatggaggggttttcagtccttatttgacttccaggttgccgtactgggccggagtgcgtcagaatgtgatgggatctaccttggacggccgacctgtggcacctgctaattcgtcaaccttaacatatgcaactgtgggaccttcgcctttggacactgctaccgccgctgcggcctctgcagccgcttccaccgctcgcagtatggcagccgatttcaacttctacagtcacttagcttcaaacgctgtgacgcgcactgcggttcgggaagacattctaactatgatgctggctaagcttgagactctaaccgctcagttagaagatctatcgcagaaggttgaagagcttgctgttgcctctacccgtacccccccagcccaacctgtagcccaataa

SEQ ID NO: 296 - DNA, 1425 bp, Adenovirus A18
  MISC_FEATURE (1)..(1425): A18.orf00054 E1B 55 kDa protein
atggagccagacgtcccagctgagttgggattacatgctggattacatggcaatgcagctgtggagggcatggctcacgaggagggtttgcatttactcgctggcgcggcctttgaccatgccgcgactgccaacgttgcaggaggaggagctggagcagcgggaccctgcggcggagaagtgaacatggaacaacaggtgcaagaaggccatgcacttgaccctgaggaagggcccagctgtgcagctgttaacattaagcgggaacgggaaacggttcttagtaggctagctgttaatataatgtctcgcccgcgcttagaaactgtgtattggcaggaactgcaaaatgagtttcagcaaggagatatgcatttacagtacaagtatggttttgagcaattaaaaactcactggttagagccttgggaagatattgagagtgctattaaaacttttgcaaagttagctttacgccctgatcgcagctataaaattagtaaaacaataactattgcttcatatgcttacattattggtaatggtgcaataattgaggtggatacaagtgacagggttgctttcagatgtcgcatgcagggcatgggtcctggggtggtggggttgggcggtattacctttattaatgttagatttgctggagacaaatttaaaggtactttgtttgaagccaacaccagccttgttttgcatggtgtttattttcttaattttagtaatacttgtgtggagtcttggattaaggtttccgcaaggggctgtacgttttatggttgtaggaggggtttagtaggcagaccaaaaagtaaaatgtctgtaaaaaaatgcttgtttgagaaatgcgtgctagccttaattgtggagggggatgcgcatattagacataatgcagcttcagaaaatacatgttttgttctagtgaagggaatggctgttttaaggcacaatatggtttgtggagtgtccgatcaatctgcgcgccgttatgttacttgcgctgatggaaattgtcatgccttaaaaactattcatgttgtgagccatgttaaacatcgctggcctgtgtgtgatcataatatgtttatgcgttgttccatgcatttaggcttaaggcgtggcatgtttgtgccttttcaatgtaaccttagtcatacaaatgtattgcttgaacctgaggtgttttctagaataagtttaaatggggtgtttgacctgtctgtggaattgtataaggttataagatatgatgatactcgtcaccgttgtcgacagtgtgagtgtggcagcagtcatctggaactccgccctgttttattgaatgtgacggaggagctgaggagtgaccaccttaccttatcttgcctgcgaactgactacgaatccagtgatgaagacggcaactaa

SEQ ID NO: 297 - DNA, 141 bp, Adenovirus A18
  MISC_FEATURE (1)..(141): A18.orf00056 E1A protein
atgttaaccacgcccaatgaaaccaataaaacacttaacagaaaaacaattttattgtacgtcactaaagggccaaaaccacccttcctttattgcacaggtgtgcaaagtccactaatcatatctagggcgtttcactga

SEQ ID NO: 298 - DNA, 135 bp, Adenovirus A18
  MISC_FEATURE (1)..(135): A18.orf00057 E1A protein
gtgttaaaacctgttccgcaacggattactggcaggcgtacccatgttgaaagcattttggatttgattcaagaggaagaaagtgaacaaacagagcctgttgatttgtcagtgaaacgccctagatatgattag

SEQ ID NO: 299 - DNA, 597 bp, Adenovirus A18
  MISC_FEATURE (1)..(597): A18.orf00059 E1A protein
atgaggacagaaattactcctttggttctgtcgtgtgaagaggctgatgacatattggaggacttggtgaacaatttttttaccgaggtacccgatgatggggatgatttttatactccttctctttatgaactgtatgatattgatgtggacgttactgacaacgattgtgatgagcaggctgtaagtgcattttttcctgagtcgctacttttagccaccagtgaggggctgttgttgacagaacctccagttatttctccagtagccgctagtgatgggctgttgttgacagaccctccgattctttctccggtatgtgaacccgttgggggtgaatatatgccccgactgcagcctgaagatgagcaggatgtacgcggaatggcattggtgtccgcatctgctatggctgctgttacgcatcatgagaagtttgagttagataatccagaactgcctgggcatgattgtaagtcctgtgaatatcatcggaatagtactggaaataatgacttaatgtgttctctgtgttatctgcgagcatacggcatgtttatttacagtaagtgcattttaaaacggggggtgggttag

SEQ ID NO: 300 - DNA, 159 bp, Artificial Sequence
  A18.orf00060 hypothetical protein
atggcgttaaacacgtcacatccggcgcgcccggctcccacgccgcgcccaacttcctcatccgcccaaacttacaaacacgcccaggccacacctccacccaatcaaagtacatcgccacacccacttcattttaatattggctctagtccagtataa

SEQ ID NO: 301 - DNA, 120 bp, Artificial Sequence; identical to SEQ ID NO: 228
  A18.orf00061 hypothetical protein

SEQ ID NO: 302 - DNA, 384 bp, Adenovirus A31
  MISC_FEATURE (1)..(384): A31.orf00003 E4 ORF1 protein
atggctgttttcgaggctgtatatgtgtattttaagggacccggggctatgttacctgaacaagaaggctattctaatgcttatgtgttattttctcctgcgaattttgttatacctccacacggagttgtgcttctatatttaaacatagcagttgatcttcctcctggatatgtgggaactttgttttccttgagcggcatgaacgccagaggggtttttgttggcgctgaaacgctttatccaggctcaagaatggagcttagtgttttgttgtttaatcactcggatgtgttttgcgatgtccgcgcaaagcagccagttgcgcgcttggttttaaatagagttatttttccacctattcgccaggcaactttactttaa

SEQ ID NO: 303 - DNA, 363 bp, Adenovirus A31
  MISC_FEATURE (1)..(363): A31.orf00004 E4 ORF2 protein
atgtttccggagtctttattgaactatttgcatggcttaaattttgaggtggtggcgtttcttaaagacgtgctacctgagttttggctgttggtaatgcattatttaactcctcctatgcgcgatgtctacgttggcgccacgcttactaatatgggcccatttgtgcaagttgtatgctctgtggggactccggaacttgtacctggaggtgaactttctttgctgctggcttctgatttgcatgattttatacaactggctttaagatgtcagctgcgagagcaaggtgtggagcctaatgtaaatctactgaatttactgcaggtgtttgaagatccagacttttttcagcaaatatga

SEQ ID NO: 304 - DNA, 351 bp, Adenovirus A31
  MISC_FEATURE (1)..(351): A31.orf00005 E4 ORF3 protein
atgaagtactgcctgcggatggcggtggagggcgcccttacagagctttttaatattcatggcttaaacctgcaaaatcagtgtgttcaaataatacaacagtggaagaatgaaaattatttgggaatggttcagtcaggcagtctgatgatagaagagtttcatgataacgcatttgctttacttttgtttgtggaaattagagccgtggctcttttagatgctgttgttgaacatttggaaaaccgcttacaatttgatctggctgtgatttttcaccagcacagcggaggtgatcgctgccacctgcgagatttacgcattcaaatacttgctgaccgtcttgattag

SEQ ID NO: 305 - DNA, 129 bp, Adenovirus A31
  MISC_FEATURE (1)..(129): A31.orf00006 E4 ORF4 protein
atgtactcagcttcaggtgtgattttcaaattatgctctttaacaaagcgaatagtatccacacaggtcgcatgggccaaaccaagccatccaatacaggcagctgtatcccgacatatgggaggttga

SEQ ID NO: 306 - DNA, 870 bp, Adenovirus A31
  MISC_FEATURE (1)..(870): A31.orf00009 E4 control protein 34 kDa
atgcagcgcgacagacggtatggttgcagactggcgccgtacagcaagtaccatctaccaccttgtgaacagcagtcaaaagctactctgtcagagaattctgcatggcctgagtgtaatagtctgactttgcataatgtaagtgaggtaagaggtattccttcatgtgtagggtttactgtattgcaagaatggccaataccatgggatatgattttaactaattatgagatgtttattttaaaaaaatacatgagtgtgtgtttgtgttgtgccaccatagatgttgaaattactcaattgttacatggttatgagcggtggctaatacattgtcattgccagcgtccgggttcattacagtgtatgtcagctgggatgcttttaggacgctggttcaaaatggctgtatatggaacattaattaacaaaagatgtttttggtatcgggaggttgttaaccattttatgccaaaagaaataatgtatgtgggaagcacctttgttagaggtcgccatttgatttatgttaaaattatgtatgatggccatgcttggttagcgctagaaaagattagttttggatggagtacctttaattatggaattttaaataacatgttagtgttgtgctgtgactattgcaaagacttaagtgaaatacgcatgcgctgttgcgctcgtcgtaccagactattaatgttaaaagttgttaaagtaattgctgagaacactgttcgcccactaaaacatagttggtgcgaaggccatcgtcagcgactgctaaagggtcttattatgcatcatcaagcaattttatttggagattacaatcatcgagaaaacccatgggcggctgatggacactga

SEQ ID NO: 307 - DNA, 216 bp, Adenovirus A31
  MISC_FEATURE (1)..(216): A31.orf00010 E4 ORF6/7 protein
atggaatgcagtttaagagactgtgcgggcgaaggatttgtttgtatcaccgactgtcgttttgcccagaaggaaaccgtgtggacgttaacaccaaaaaaccaaagtagaaacattcaagcgcagctgttttccgcaacaaagtgggagagggaggtatacaaggtgaaatgggaagaaggcagtataactactcgtattgtaaaaaagaattaa

SEQ ID NO: 308 - DNA, 1668 bp, Adenovirus A31; identical to SEQ ID NO: 131
  MISC_FEATURE (1)..(1668): A31.orf00012 L5 fiber

SEQ ID NO: 309 - DNA, 159 bp, Adenovirus A31
  MISC_FEATURE (1)..(159): A31.orf00013 U protein
atgaagatggtgggtaggaattgggaagaaaattctgacattccatttaaaatttggagaaaatttgctgtttgcaagtctattggctttgatagttgggaagaaggaaattttgtaagagtacatggagaccacaatgtatttttaaatttcaggtaa

SEQ ID NO: 310 - DNA, 387 bp, Adenovirus A31
  MISC_FEATURE (1)..(387): A31.orf00014 E3 control protein 14.7 kDa
atgattgaacccgacctacaaatggatggaacaatgaccgaacagaggttgcttgctgatcgcgctaggcgtcgccaacaggatcaaaaaaataaagagttacttgatttacaaaccgttcatcagtgtaaaaaaggacttttttgcctggtaaaacaagccaccctccgctacgagaatttaccaggcaaagagcatcaactttgctacacgctgcctactcagcgacaaagcttcaccgcagtcgtgggttcggtgcctattaaagtgtcccaacaagcaggacagcaagaaggctccatttgctgcctatgtaccagccctgaatgtttgtacactttaataaaaacactgtgcggcataagaaagcttttaccaatgaattaa

SEQ ID NO: 311 - DNA, 294 bp, Adenovirus A31
  MISC_FEATURE (1)..(294): A31.orf00015 E3 RID-beta
atgttggccacttcttgtaagcttcacgtgccatggactttcttagactgctacaccaaagagacagattacataggctgggtgtatgggattatgtctgccttagtttttgtatcctctgtagtttccttaaaactttatacgcttattaattttagttggaatcaatacactgatgatctccctgagtacccacaccaccaggatgatttacccctaaacattgtacttccacagcccccacgtcctccttcggttgttagctattttaagttcgccggtgaagatgattga

SEQ ID NO: 312 - DNA, 276 bp, Adenovirus A31
  MISC_FEATURE (1)..(276): A31.orf00017 E3 RID-alpha
atggtgacggttcttcttatattcttatgcctgccaatcattttttcttcttcaacttttgcagcagtgagtcacattgatcctgattgtatagcaccctttgcggtgtatttgatttttacatttgtgaccgccacgtgcgtctgcagtcttataactttacttcttacctcgcttcaattttttgattactactacgtgcgatacgtttaccgcagacatcaccctcgttatcaaaacccccacattgcagctcttctccatctacaaccatga

SEQ ID NO: 313 - DNA, 753 bp, Adenovirus A31
  MISC_FEATURE (1)..(753): A31.orf00018 E3 CR1-beta
atgcttagtattttagtctttgtttttttacctttcctcctacatgctcaaacatctgagaaaccattgaaagtatttgtggaagttggccataatgtaaccctcccccatctcatgcctgattcacacgaaacaggccatgtgacttggctagtagaaacagcagattacggtgtagcttctccaaacaactttatttttagtggacaaaaactatgccagtttacttccagaactatggtgtggccttatgccaatctagattttaactgcgctaattatgacctccatttgtttcggcttaaggtagaaaattcagccatttacaatgttaaaaataccatcaatgcatctgaaatgaatatctactatcaattaacagtaattgacattcttccacccaaatgcatcattacttcaaagtacctcacaaataattattgtcacattaccattaactgcaccaactcggtgtatccaaacaaagttcagtttaataatgtcactcgattctactatggatacgccaagggaggcccaaacctacctaattatttcaccactaattttaatgtatcaggtattactaaaagctttaaccacagttacccttttaatgagctgtgtgatgaccccgtgttccaacctcagaataatttaaaaaacacggtgattttcttagtaataattgcatttagcgttctcattattattgcagccctcacttacctgtgctgtcacaaacagacttaa

SEQ ID NO: 314 - DNA, 789 bp, Adenovirus A31
  MISC_FEATURE (1)..(789): A31.orf00019 E3 CR1-alpha
atgaagatttttgctgtcatttgtgtgctgaatttaatcatttgtagtggcggtttaccgcctgaagaagaacctaactgtcatccgcctcttagtaacattaaaattaacctttcaatctctgacattactcttcgctgcaattttttctccacccatctcacctggagttttaacggaaaacccatcgccgaggtaaaattaaagtttcagctacacaaagaaaacatcactttatttgcacctattcacctgggatactaccgctgcgcagctccaccctgtcagcaagccttttttgtttctccgattattaacagaaaacctgctacaacaacacctgtcactcggcaaaacatccagacgacttctcctactaaaggtatagaggaaattgtgtacttttcaaactttacaaaccacttacttttaaactgttcctgctctaactccttaatctcatggtttgctaataacactttgtgtaaagctttttaccaacaaaaacttttgtattctgccaatttaacactgtgtaaccaaaccacttcttcccaccttactctactaccaccttttgtcgctggtcgttatttttgcttaggagctgccggtactagcccctgtcaacagcactggagattaacttatcgcccaacgccagtaacgccttctgtaataacagaggcatttacctctaataccttgcttctatatagtggtcttgtggctcttactctatttctaatttctaacttgtttctagtgcagcatttgtatttgtactaa

SEQ ID NO: 315 - DNA, 318 bp, Adenovirus A31
  MISC_FEATURE (1)..(318): A31.orf00020 E3 12.5 kDa immune modulating protein
atgtctaatggagcggccgacagagcgcggctgcgacatttagaccactgtcgccaacctcgctgctttgctcgagacatctgcgagtttacttactttgagctgccagaggaacaccctcagggaccagctcacggcgtaaggataacagttgaaaaaggaattgatacacacctcattaaattttttaccaaacgcccgctattggttgaaaaggatcaagggaatactgtactaactctatattgcatttgtcctgcccccggattacatgaagatttttgctgtcatttgtgtgctgaatttaatcatttgtag

SEQ ID NO: 316 - DNA, 702 bp, Adenovirus A31
  MISC_FEATURE (1)..(702): A31.orf00022 L4 VIII capsid protein
atgagtaaagatattcccacgccttacatgtggagttttcaacctcaaatggggctagcggcgggtgcggctcaagactattctactaaaatgaattggttaagcgccggcccacatatgatttcccaagtaaatggaattcgcgcccggcgaaaccaaatgctactacaacaagccgctctcaccgctacaccgcgtaaccagcttaacccaccctcttggccctctgccctattgtaccaggaaagtccccctccaacaacggtacttttgcctcgcgacgcccaggccgaagtccgcatgactaatgctggcgcacaactcgcgggcggcgcacgtcatagtttcaggtataaaggtcgccctgggccgtactcatcttctgctataaaaacaatacgcattagaggaaaaggtattcagctgaacgacgaggcaacatcgccactgggactcaggcccgacggagtgtttcagctggcaggctccggccgctcgtccttcactactcgtcaagcctacctaacacttcagagttcgtcaacagctccaagatccggcgggattggaactcttcaatttgtggaggaatttactccatctgtttactttaatcccttttcgggctcgcctggacactatcctgacgccttcatacccaactttgacgccgtgagcgaatctgtggatggttatgattaa

SEQ ID NO: 317 - DNA, 333 bp, Adenovirus A31
  MISC_FEATURE (1)..(333): A31.orf00024 L4 splicing factor
atgttctccattactaccgtcatctctacagccccttcgaagagatccacaaagaatcgacgtcttacggaccagcggcccactagaaaaaccggcagcagcaacaaggaaagtccagaggcgcgcgagttaagaaaacgcatttttcccactctatatgctatttttcagcagagccgaggccaagaacacgaactgaaaataaaaaacagatccctccgttcacttacccgcagctgtctctacctcaaaagcgaagaccagttgcaacgcaccttgcaggacgctgaagctctgttcaataaatactgctccctctcgcttaaagagtaa

SEQ ID NO: 318 - DNA, 2328 bp, Adenovirus A31
  MISC_FEATURE (1)..(2328): A31.orf00027 L4 hexon-assembly protein
atggatccgcagtcaaaggaaaacttaaccgcccccaccgatactgctgttgctgccatggaaaagaacaaatgtctactcataccccaagatgcaccgcttgcgcaggactcgggctacgtgactccccccgaggaattggaaggctctcttctaatccaagagcaaccaaataaggaacaggcagaaagcaatgagcaagacgctgagctccatgactacctaggcaagggagatgtcttgcttaaacatttacagcgacaaagcattatcgttcgcgacgccgtagctgaccgctctttattgccagtctcaatcgcggaactttcttgcgcatacgaacgcaacctgttttctccccgtgtgccgcccaaacgacaagccaatggtacctgcgaaccaaatcctcggctgaacttttacccggtttttgcgataccagaagctctggcaacataccacattttttttaaaaatcatagaatacctctgtcttgccgagccaaccgcagtcgcgcagataagctccttacccttagcggtggtgcttccatacctggtatagtgtccttggaagaggtgcctcggattttcgaaggcttggatcgcgatgaaaagcgagcagcaaacgccctacaagcagaaaacaagcaaaatcaaagtgcgctcatagaactagaaggtgacaatgcccgtttggccattttaaaacgcaatgttgaagtaactcacttcgcatacccggcagtgaatcttccgccaaaggttatgagcgcagtaatgaatcaactactaattaagcgcgctcagcccattgacaaagatgcaaacttgcaagattcagaggcatcagatgatggaaaaccagttgtaagcgacgagcagctaattaagtggctgggaacagacaaccccgccaaactacagcagcggcgtaaacaaatgatggcggcagtacttgtaacggtggaactggagtgcatgcaccgttttttttccaacgttagcacgttgcgcaaaattgaagaatgtctccactacacctttcggcatggttatgtgcgccaagcctgcaaaatttccaatgtggagctaagcaaccttatctcatacatgggtattttgcacgaaaacagattgggacaaaatgtgctacattcaacgctacgcgacgaagcgcgcagagattacgtgcgggactgtgtttatctttttttgctacatacttggcaaaccggaatgggggtgtggcaacaatgcttggaagaaactaacctcagagaactcaacaaactgcttgacagagcgttgaaatcattatggacaggttttgacgagagaacggtagcggcagatttggcaaacattatttttccagaaaggctcatgataaccttgcaaaatggtctgcctgactttatgagtcaaagtatgctgcataattaccgttcttttatattggagcgatctggcttgttacctagcatgtgctgtgcgcttccttcagattttgtgcccattcattttagagaatgtccccctcctctgtggagtcactgctacttgttcaaacttgccaattacttagcttaccactcagaccttatgacggattccagcggagaaggattaatggagtgtcactgtcgctgcaatttatgcactcctcaccgttctctggtgtgtaataccgaactgcttagtgaaagccaggttattggtacgtttgaaatgcaaggaccgcactctgatagcaatctcaccacaaacctgaggctgacacctggcctttggacttccgcttacctgcgcaaatttgaacccctagattaccacgcacacgttattaatttttatgaagatcagttaaagccccctaaagcgccactaacggcctgcgtcattacgcagggaaaaattttagcccaattacaagccattaaacaagcgcgcgaagaattcttactcacaaaaggacgcggagtgtaccttgacccccagaccggcgaggaactgaaccttccatcacctctgtgtgctactgcatcctctccccattcgcagcatgtccccgaaaaccgcaaaacaagctattgcgcagcaacgctcaaagaagcagctacaacagcaggaaatctgggaggaagattcttgggacagtcaggcacaggaggaccaggacttggaagaatgggaggaggaaagcctagacgaggatccagaggaggacggttccaaggacggagcgaccgccgcaaaaccgtcgctttcaaccgaaccctctccagtgaaacacactgtcaacaaatctcagaaagcgagccgtag

SEQ ID NO: 319 - DNA, 1458 bp, Adenovirus A31
  MISC_FEATURE (1)..(1458): A31.orf00029 E2A ssDNA-binding protein
atggccagcaatcagcactcacagagggagcgcaccccagaccgcaacactcagccgccacctccaaaaatgggtcggtactttttggaatcagaaagcgaagaagacctggaggctgtgcctttgcctccaaagaaaaaagccaggaggtccatggctaccatccctctatctccggagagcgaaaaagaagaagaaaccgagccgccaaatgcagtcttaggagtcatgggtttcagcatgcctcctgttcgcattatgcatcatgcagacggttctcagtcttttcaaaaaatggaagaaaggcaggtgcgcattttaaaggccgctgctcaaaacatggaaggcaaagaacaaaaaggcgtagtaatagttcgcaaccccacgagcgagcctctgatatcagcttgggaaaaaggcatggaggcaatggctatgctgatggagaagtaccatgtggatcacgacgagcgtgccagctttaggtttttgccagatcagggagcggtgtacaaaaaaatttgtacaacatggctaaatgaggaaaaacgcgggttgcagctaactttttcatcccagaaaacctttcaggagcttatgggacgcttcctacaaggatatatgcaagcctatgccggtgttcaacaaaatgcctgggagccaactggttgctgtgtatgggagcaccagtgcactgaacgcgaaggggagcttagatgcctgcacggcatggaaatggtgcgcaaagagcacttgatagagatggatgtaaccagcgagagcgggcagcgagctctgaaagaaaatccatctaaagccaaggtagtgcaaaaccgctgggggcgtaatgtagttcaaattaaaaatgatgacgcccgctgctgttttaatgatgttggctgcgggaataattctttttccggaaagtcatgcggtttgttttattcagaaggaacgaaggctcaaatggcttttaggcaaattgaggcttttatgttggccgactaccctcacatgcgacaggggcagaagcggttcctgatgccagttcgttgtgaatgtttaaacaagcaagatggcctgccgcgcatggggcgtcagctgtgtaaaattactccatttaacctcagcaatgttgaaaacatcgacgttaacgaagtcagcgaccctggagccctggccagtattaagtatccatgtttgctggtttttcagtgcgcaaatccagtttatcgcaatgcccgcggtaacgccggtcctaattgcgacttcaagatatcagctcctgatgtcatgggtgcattgcagcttgtgcgacagctatggggagaaaattttgaaggcccgcttcctaggcttgttattccagagttcaagtggcatccacgtttgcagtatagaaacatagccctgcccaccaaccatggcgattctcgagaggaaccgtttgatttttaa

SEQ ID NO: 320 - DNA, 612 bp, Adenovirus A31
  MISC_FEATURE (1)..(612): A31.orf00031 L3 protease
atgggttcaagcgaacaggagctgacggcgattgttcgagatctaggctgtggaccctattttttgggtacctttgacaaacgttttcccggttttgtgtctcgcgaccgcttatcatgcgctattgttaacactgccggtcgcgaaactgggggcgtacactggctggcctttgcatggaatcccaaatcgcacacttgctatttattcgatccatttggattctctgatcagcggttaaaacaaatctatcagtttgagtacgaaagtctgttgcgccgtagtgcgctagcggccactaacgaccgatgcgtcaccctagaaaagtcaacacaaactgtacaaggaccgttttctgcagcgtgcggcctgttttgttgtatgttcttacatgcttttactcactggcctgaccatccaatggataaaaatcccactatgaatctactaactggggttccaaatagtatgttacaaagtccgcaggtggaggacacactgcggaggaatcagcaagaactatatattttcttaaacaaattgtcaccttactttcgcaacaaccgccagcgcatagaaaaagccacctctttcactaaaatgaaaaattga

SEQ ID NO: 321 - DNA, 2754 bp, Adenovirus A31; identical to SEQ ID NO: 191
  MISC_FEATURE (1)..(2754): A31.orf00032 L3 hexon

SEQ ID NO: 322 - DNA, 783 bp, Adenovirus A31
  MISC_FEATURE (1)..(783): A31.orf00033 L3 VI capsid protein
atggaagacatcaatttttcgtcgctggccccgcgacacggcacgcggccgtatatgggcacctggaacgagatcggcaccagccagctgaacgggggcgccttcaattggaacagtatctggagcggtcttaaaaattttggttccacaattaagacatatggctccaaggcgtggaacagccaaaccggccagatgctaagggacaagttaaaagaccagaacttccaacaaaaagtggtagacggtctggcttctggaatcaatggagttgtagacatagctaatcaagctgtgcagaaacagattgccaaccgtttagagccgcgacccgacgaagtaatggtagaggaaaagttaccgcctctggaaacggtgcccggatcagttccgtccaaaggagaaaagcggccgcggccagatgcagaggaaactctagtcacgcacaccatagagcccccttcttatgaggaagcagttaaacaaggagcagctttggcacctactacttatcccatgaccaagcctattctacccatggctaccagggtgtatgggaaaaatgaaaatgcgcctatgactctcgagattcctcccttgccagaacctactgttgcggaacctgtggttactgctccgattgtttcaactgtatcgcgtccagaagtgcggcctgttgccgtagcaagctcacgaaacccgcgatccactaattggcaaagcaccctaaacagcattgtgggactgggagtaaagtctttaaaacgcagacgctgctattaa

SEQ ID NO: 323 - DNA, 1035 bp, Adenovirus A31
  MISC_FEATURE (1)..(1035): A31.orf00037 L2 V core protein
atgaccaaacgcaagttcaaagaagagctgctgcaggccgtcgcgcctgaaatatacggcccagcggattacattaccaagcgcgaaatcaagcatgttaaaaaactggaccaaaaaaaagaggaagaaatggccgcagcgctagcggacgaagtcgacttcgtgcgctcctttgcgcccagacgtagaatacagtggaaagggcggtcagtaaagcgagttttgcgacccggcactacaatagttttttctcctggggagcgaacggctatgcgccccctcaagcgcgaatacgatgaagtgtatgccgatgatgacattttggaacaggctgcccaacaggctggtgaattcgcctatggaaaaagaagccgttacgacgacaaaattgctattcctttggacgagggaaatcccacacccagtttaaaggctgtcactttacagcaagtattacctgtgctcgcgacctcagaagaaaagcgaggcataaaaagggaagctatgaatgacttacagcccacaatgcaacttatggtgcccaagcggcaaaagttagaggacgtactagagtacatgaaggtggatcccaacattcagccggacgtaaaaatacgtcccataaaaaaagttgccccaggattaggagtccaaacagtggacatccaaattcccgtacaagctgcgcaaagtaaaactatggaaacccagacttcgccaataaaaacagcagtggacagcggcatgcaaaccgagccttggtacccgccaacttttacaagaaaaaaacgccactacaaacaaacaaacgcgctcttgccagaatacgtgctacatccttccattgtgcccacgccggggtatcgcgggtcaactttccagcgcagagccctagtttatagtcgcagaagaactccgtcgcgacgcagacgtcgacgcagagccaatttagctccagcatcagtacgccgcgttgtacgaaaagggcgcacactgacgcttccatctgtgcgttaccaccctagcatactctaa

SEQ ID NO: 324 - DNA, 564 bp, Adenovirus A31
  MISC_FEATURE (1)..(564): A31.orf00038 L2 VII core protein
atgtccatcttggtttcgccaagtaacaacacgggctggggattgggagctggccgcatgtacggaggagctaaaaccaggtccagccaacatccagttcgcgtccgcggacactatcgagcgccatggggagcacatacccgcggacgcactggtcgcaccactgtggacgatgttatcgactcggtcgtagccgatgctcgaaaataccgtccaccagccaatacagcagggtctaccgttgatgcggtcattgatgaggtagtggcaaacgcacgagcttatgccagacgtcgcagaaggccgcgtcggcgccgacctactgctgctgtgcgtgcggctagagcgttagtgcgacgcgctagacgcgtcggacgtcgagctatgctgcgagcagccaggcaagctgtaacgcctgccggtagagcgcggagacaggccgcagctgcggccgcaacagctattgccaacctagccgctcccagacgaggaaatgtgtactgggtgcgcgacgcggtaactgggactcgagtcccggttcgtacgcgtccacctcacccttag

SEQ ID NO: 325 - DNA, 1518 bp, Adenovirus A31; identical to SEQ ID NO: 163
  MISC_FEATURE (1)..(1518): A31.orf00039 L2 penton

SEQ ID NO: 326 - DNA, 1737 bp, Adenovirus A31
  MISC_FEATURE (1)..(1737): A31.orf00040 L1 IIIa capsid protein
atgcagcgaccggctatcatcacggacggggcccgtaacctggatcccgcggtctcggcggccatgcaaagtcagccttctggagttacggcttcagatgactggacagcggccatggatcgtattatggctttaacggcgcgcagtcctgaggcttttcgccagcagccgcaagctaatcgattttctgccattttggaagcagtagtgccgtctcgaactaatcccacccatgagaaagtgctaaccatagtgaacgctctgttggacagcaaagctatccgtaaagatgaggctggtcttatatacaatgctcttctggagcgcgtggcgcgctacaacagtaccaacgtacaggctaacttggaccggatgggtatggatgtaaaggaagcacttgcgcaacgagagcgatttcatcgcgacggcaatcttggctccctggttgcgctaaatgcctttttaagctctcagccggctaatgttccgcgcggtcaagaagattacacaaactttataagcgctttgcgcctgatggttactgaagttccacaaagcgaagtgtatcagtctggtcctgattatttctttcaaacttccaggcaggggttgcaaaccgtaaatttaagccaagcttttaagaatttgcaaggcctgtggggggtacgcgctcctgtgggtgatcgctcaactgtctccagtctgttaacgccaaattctcgattattattgttgttaattgccccttttaccaacagcgatagtttaagtagggattcgtatctaggtcacttaattactttgtatcgcgaagccattggtcaagcgcaggtagatgagcaaacgtatcaagaaataaccagcgtgagtcgcgctctgggacaggaggatacaggcagtttggaagccacgcttaactttttactaacaaaccgccgtcagcaagtgcctccgcaatacagtttgaatgcagaagaagagcgcatactgcgctacattcagcaatcagtgagcttgtatttaatgcgcgaaggcgcaacgcccagtgccgctttagatatgactgcgcgcaacatggagccgtcattctactcttccaatagagcatttattaatcgtttaatggattaccttcaccgagccgcggccatgaacggagaatactttaccaacgcgattttaaatccgcattggttaccacctcctggtttttatactggagaatttgatttaccggagggaaacgatggctttttgtgggatgatgttacagacagtctgttcagcccggcagccattggtcaccatggtaaaaaggagggagcagatgaaggtccgttactaagctctcgggcaagttcgccgtttcccagcctaagcagtattaacagcggtcgtacaacaagaccgaaactatcaggggaaagcgagtatttaaatgatcccctgttacgtccagcacgcgacaaaaattttccaaataatggcatagagagcttagtagacaaaatgtctcgttggaaaacgtatgcgcaagagcggcatgaatgggaagagagacaacccaaaccggtgccccctccgagacaacgctggcaacggcgtaaaaaaggagcgcatgcgcttgacgaaggaagcgatgactcagcagatgacagtagtgtgctagacctaggagggacagggaacccatttgctcatttgcgtccgcaaggtcaactagggcggttgtattga

SEQ ID NO: 327 - DNA, 1110 bp, Adenovirus A31
  MISC_FEATURE (1)..(1110): A31.orf00041 L1 52 kDa protein
atgcatcccgtcctgcgacagatgcgacctcaatccagggcacccacgccctcaggaccaatagcgcttgggggctctggcgaacctgaagagccttccacgttggagttggaagaaggagaaggcttagcccgtctgggcgctcactctcctgagcgacacccaagggtgcagcttactcgcgatagtcgtgcggcgtttgtgcctcggcaaaatatgtttcgagataacagcgggcaggaggctgaggaaatgagagactgtagatttagggccggccgcgagctgcgttgcggacttaatcgcgagcgactgctacgagaagaagattttgagcctgatgaacgttctgggattagtcccgcgcgagctcatgtttccgcggccaacttagtgtcagcctatgaacaaaccgttacagaggaacgtaattttcaaaaaagctttaataatcacgtgcgcacgctaattgcgcgtgaagaagtggctattggtttaatgcatctttgggactttgtggaagcgtatgtacataatccagcaagcaaacctttgactgctcagctttttttgatagtacaacatagtagagataatgaaacatttagagacgcaatgcttaacattgctgagccacagggtcggtggctacttgatttaattaatatcttgcaaagtattgtggttcaggaacgcagtctcagtttagcagacaaagtggctgcggtcaattattccatgttaagtttgggaaagttctatgctcgtaagatatacaaaagtccatatgttcccattgacaaggaagtaaagatagacagtttttacatgcgcatggcgttaaaggtactaacattgagcgacgatttgggagtataccgcaatgatcgaatccacaaagcggtgagcgcaagtcgtcgaagagaacttagtgacaaggaacttatgcatagcctgcaaagagcgctaacgggagccggaacagaggacgagtcctttttcgatatgggcgcagatctaaagtggcagccaagcgcccgcgccctggaggcggctggccaggataatgatgatgatgatgatgatgacgaagaccagtacgaggactga

SEQ ID NO: 328 - DNA, 1761 bp, Adenovirus A31
  MISC_FEATURE (1)..(1761): A31.orf00045 pTP DNA terminal protein
atgtccagatacatatatgaataccaccgcctcatgttagaagaccttgctcccggtgcggcggctacacttcggtggccgttatatcaagaacctcctcctcattttctagtgggctatcagtatttggtgcgcgcttgcaacgattatgtttttgactctcgagcttactcgcgcttacgatacacagaaaccatacagccaggtgtccacactgttaattggtcagtaatgaccaactgcagttacaccattaatacaggagcttaccaccgctttgtagatatggatgactttgaaaatactcttacccaaatacagcaggcagtacttgctgaacgggtagttgcagatttagctttattgcaaccattacaaggctatggtgcaacgcacatggctgatcgccaagaccgcgaaataccagtggaaaggctcatgcacgactactacaaagatcttggacgttgtcaaagtagtgtgtggggaatggcagaccgcctgcgagttcaacaagccggaccaaaagacgtggtgcttcttaaaaccatccgcagacttaaaacagcctattttaattacatgattagcaacatagttcaacatcccggtgattcacagcaaacaaaacttagcctaccttgtgactgtgactggattgacgccttccttgaaaggttttccgacccagtagatatgcagtcgcttaggtcctggcgcggagtttctacgcaacaaatcataaaatgcatagtaagtgctgtgtcgctaccaaacgcacctcgcaacgcatttcctaccctacaactaaggggtggacttttcgagcttcgcccgcgtgaaaatggtcgagcagtgacggaaactatgcgccgccgccggggcgaaatgattgaaaggtttgtagacaggctgcccgttcgccggcgacgaagaaggctaccctctccgcccgcggttcaagaagaaacaatggaagtagaagaggaacaggaagaagaagccccggaggctttcgcgcttgaagtgcgccacacggtggctgaaattattcgtcttttagaagaagaattaactgttgcagctcgaaactcccagttttttacttttgcagttgacttctacgaagccatggaacgtttggaagctctgggagacatcaacgagctcacgcttcgtcggtggattctttatttttttgtttcagaacacatagctactaccttaaactacctgtttcagcgtttacgcaactacggtgtgttcgcgcgcttcgtggaacttaacttggcgcaagtggttatgcgtgccagagacagcgacggaggagttgtgtacagccgcgtctggaacgaaactggacttaacgcattttcacagcttatgggacgcatatctaatgaccttgcagctaccattgaacgagcgggtcatggagatctccaggaggaagaaattgatcaactaatggcagaaattgcctaccaagataactcaggggatattcaggaaattttgaggcaggctgcagtaaatgacactgaaattgattctgttgaactttctttcaggttcaaaacaacgggaccagtggtgtttacacaacgtcggcaaattcagaacatcaatcgtcgtgtcgtcgcccatgccagtcaactacgggctcagcaccttccactaccagaacgtcaggccgacatacgactgcctcaagctcccgcagaagcggaagtcccagttcctgcacgccgtcgcttttaa

SEQ ID NO: 329 - DNA, 3165 bp, Adenovirus A31
  MISC_FEATURE (1)..(3165): A31.orf00046 E2B DNA polymerase
atggacagttccagactgcaagctttgatttcctgcttcagccccgctcgagccgaaatatggacgtgcagcggtcgaggcgccgttaccctttccgttgtcactttcaaggatccaaacggtgacaacgatgcaacagaacaggaagacaacgaacggcaactgccaagaagtggcatccattttcccatgcgctttttggtgcgcggtcgtcaggtgcacctcattcaacacatacagcccatgcaacgatgcgaatactgcgcacgcttttacaaacatcgacatgaatgctctgctcgccggcgagatttctacttccaccacattaacgcccactcttccaactggtggcaggagatccagtttttcccggtcggttcgcatcctcgcactgaacgtctttttattacctatgacatagaaacctacacctggatgggctcgtttggaaagcaacttgtaccatttatgctggtaatgaaactgtctggggacagtagccttgtagcgcacgcattacaacttgccttagaacttggatgggaccaatgggagaaagactcctctactttctattgtattaccccagaaaaaatgaaggtcggtcagcaattccgtacctacagaaatcgcttgcaaacgtctttagccgctaacctctggaatacttttttacaaaacaatccgcagttgcatcagtgggcgcaacagcaaaatggtctggttagtcctgacgatctgacctttgaacagcttaaaaaagctcctgtcatcaaggggcagccaagatttctagagttatacatagtggggcacaatattaatggatttgatgaaatagttcttgccgcgcaggtcataaacaatcggtcagatgtaccggcgccatttaaaatctctagaaattttattccaagagctggtaaaattttatttaatgacataacttttgctctccctaatccttactacaaaaagcgcactgacttcctgctgtgggagcaaggaggatgtgacgaccaggactttaaataccagtatttaaaagtaatggtcagggacacctttgctttaactcatacatctttaagaaaggccgctgaagcttatgccctgcctgtagaaaaaggttgttgtccctacaaggccataaatcaattttacatgcttggttcttaccgcgctgatgcagatggtttccctgtagaggagtattggaaggataaacaggaatacctcctaaaccaagaactatggaaaaaaaaaggagaaaaaaattacaatcttattctggaaactttaaactattgcgccctggatgtcatcgttacgaccttattggtagaaaaactgcgcagttcctacgcccagtttgttaatcagtcggtgggtcttcagcaggcacacttcaatgtgtttcaacgtcccaccatctcctctaactctcatgcgctttttcgacaaattttgtatcgcgcagagaaaccaaaacgcacacatttaggccctaaccttttggcgccttcgcacgaactatacgactatgttcgcgcaagcattcgcggcggcaggtgctatcctacctatataggtgttatacaggaacccatatatgtatatgatatttgtggcatgtatgcatcagcccttacacaccctatgccttggggtcctcctcttaacccttacgaacgagcattagccgtacggcagtggcaggtggcacttgaaaatcttacttccaaaattgattattttgataaaattttatgtcctggcatttttactgtggatgctgatcctccagacgagaaccagctggatgttcttcctcctttttgctctcgaaaaggcggtcgtttagcctggactaatgagagcttgcgcggcgaagtggtcaccagtgtagacttagttacactgcataatcgcgggtggcgtctgcgattattaccagacgaacgtaccaccgtttttcccacttggaaatgcattgctcgtgaatatgtacaactcaatatcgccgcaaaagaacgggcagacagggacaaaaaccaaacgctaagatctatagccaagttactttcaaacgccctgtacggatcctttgctacaaaattagataacaaaaaaattgttttttctgatcaaatggaagaggggctcataaaagaaattgcagcgggccgtttgcacatcaaatcctcatcgtttatagaaactgatactttgagtacagatgtgttacctgcctttcagcgcgcgtactcaccgcaacagctggcgctcgtaaacagcgaagccgaagacagcgatgaagatcagtgtcccacccctttttatagccccccaccagggaactctgatcacgtgacttacacctacaaaccaatcacattcatagatgctgaagaagaggatatgtgcttacacaccttggaaagttccaaccctttaattagtaacgatcggtacccttcccatgtggcctcgtttgtactggcttggactagggcctttgtgtcagagtggtcagagtttctgtacgaggaggaccgtggaatagccctaaaggacagacccattaaatctgtatacggagacacagacagtctttttgtcacagagaaaggacgccgccttatggagtcgcaaggtaagaaacgcatcaaaaagtatggagggaaacttgtttttgatccatcttatcctgagctgacctggtcggtggaatgcgaaactgtttgtgctaactgcggtgcagatgcttacgctccagagtctgtttttttggctccgaaactgtacgcccttaaatgccttcagtgtcctgattgtggcagcacttcaaaggggaaaatacgggctaaaggtcacgccacggatgccttatcttatgatctcatgttaaaatgctaccttgccgaagcacagggagaagacacacacttcagcaccagccgcaccagcttaaagcgcacgctggccagcgcccaaccaggggcgcatccgttcaccgtgaccgaaacaaccctgacgcgcaccttacgtccatggaaggacaaaaccctggtgcacttggatgctcatcgccttgttccttacagcaacagccagcccaatccccgcaacgaggaagtctgttggatcgagatggaatag

SEQ ID NO: 330 - DNA, 1053 bp, Adenovirus A31
  MISC_FEATURE (1)..(1053): A31.orf00047 IVa2 maturation protein
atgccaatggctgacggtctgaaaccattaaaaactttcaactctttgcaagagttgctctccttgggcggtgaacgccttctcagggaacttgtcaagcaaaacatgcaagtcaagcaaatgatgaacgatgtggctccgcttctccgcgacgacggcagctgcacctcgttaaactatcacttgcagccagttattggggtgatttatggacctactggatgtgggaaatctcagttgttgcgtaacttgctttccgcccagctggtcacacctgctccagaaactgttttttttattgttccccaagtggacatgattccgccttcggaaattaaatcttgggaaatgcaaatttgtgagggaaattatgccccgggaccccagggaaccattatcccacagtccggaacgctctgccctaaatttgttaagctctcgtacgatgatttaacgttagaccacaactatgatgtttctgatccaaagaacatttttgctaaagccgctgcttgcgggccaattgctataataatggatgagtgtatggaaaatctgggaagccacaaaggcgtctccaaattttttcatgcctttccttccaaacttcatgataaattccccaaatgcactggctacactgtttttgtggttctccacaacatgaatccgaggagagatctggcaggaaacattgccaatctcaaaatacaatcaaaactacatattatgtccccccgtatgcaccccacccagcttaaccgctttataaatacctacactaaaggtcttcccttagcaatcagcttgttgcttaaagatatatttcaccaccatgcccagcgctgttgctacgattggattatttacaacaccacccctgagcaagaagccctacagtggtcctacctgcatcccacagatggtcttatgccaatgtaccttaacatacaagcccacctttacaaaatattggaatacattcaccgtgttcttaatgatagggaacgatggtccagagcttaccatgtcagaaaaaacaaacatcaataa

SEQ ID NO: 331 - DNA, 435 bp, Adenovirus A31
  MISC_FEATURE (1)..(435): A31.orf00050 IX hexon associated protein
atgaacggaactgctggggacaacgctgtgctttttgatggaggggttttcagcccttatttgacgtcaaggttaccgtattgggccggagtgcgtcagaatgtggtaggatctactccagacggacgacctgtagcgcctgcaaattcgtcaacgttaacctatgcaactgtgggaccttcgccgttggataccgccgccgccgctgcagcttctgcggcggcttgtacggctcgcaatatggcagctgattttagtctctacagccaattgacatcgaatgccgcaatgcgcactgcagtccgaggagacattttaactgttatgcttgcaaagcttgagaccttaactgctcagctagaggagctgtcgcataaggttgaagaattagctgatgctaccactcccaccctaccacaacctgttagtcaataa

SEQ ID NO: 332 - DNA, 1419 bp, Adenovirus A31
  MISC_FEATURE (1)..(1419): A31.orf00051 E1B large T antigen
atggagcgagaggtcccacctgagctgggattacatgctggattacatggcaatgcatttgtggagggcatggctgaagaggagggtttgcatttactcgctggcgcggcctctaaccatgccgccgttgcaggaggagcagcagaacactacgacggaggagtaaacatggaaccacaggtgcaagaaggccatgaacctgaccccgacgaagggcctagttgtgcagttgttaaaaagcgggaaagaaaagaaagtttaaaggaaactgtccttaataggctgactgttaacctaatgtctcgcccgcgcttggaaactgtatattggcaggaattacaggatgaatttaagcagggacacatgcatctacaatacaagtacagttttgagcagctaaaaacccactggctagaaccatgggaggatttagagtgtgctattaaagcttttgctaaagtagctttacgccctgactgtacttataaaatctctaagacagtaactattacgtcatgtacgtacattataggcaatggggcagtagttgaggtggacactagtgatagagttgcttttaggtgtcgtatgcagggcatgggtccgggggtggtaggtttggatggcattacatttatgaatgttaggtttgctggagaaaaatttaagggcattatgtttgaggctaacacaagtgttgtgttgcatggtgtgtactttcttaactttaataacacgtgtgtagagtgttggaataaggtttctgccaggggttgcactttttatgggtgttggaaggccttggtaggtaggcccaaaagtaaaatgtctgtaaaaaagtgcttgtttgagaaatgcgtgcttgctttaattgtagaaggggatgctcacattagacataatgcagcttcagaaaatacctgttttattctactgaagggaatggctattttaaagcacaatatggtttgcggggtgtctgatcagacaatgcgacggtttgtcacctgtgctgatggaaattgtcacactttgaaaactgttcatattgtgagtcatgctagatattgttggcctgtgtgtgaccataacatgtttatgcgctgcacaatacatttgggtctccggcggggtgtgtttagaccttcccagtgtaactttagtcattcaaatgttatgttggagcccgaggcgttttccagagtgagtttaaatggggtgtttgatttatctgtggaattatgcaagattatcaggtatgacgatgctgcccgtcatcgctgccggcagtgcgaatgtggcagtagtcatctagaacttcgccccgtcatgctgaatgtaactgaggagctaagaagtgaccatcttaccctgtcttgtctgcgaaccgactatgagtctagcgatgaagacaactaa

SEQ ID NO: 333 - DNA, 873 bp, Adenovirus A31
  MISC_FEATURE (1)..(873): A31.orf00053 E1A 29.5 kDa protein
atgagaactgaaataactcctttggtgttgtcctatgaagaagccgatgacatattggagcatttggtggagaacttttttaacgaggtacccagcgatgatgatttttatgttccctcgcttcacgaactgtatgatattgatgtggagtctgccggtgaggattctaatgaacaggctgtgaatgatttttttccggaatcgtttattttagctgctgctgaaggggtaatattaccggagccccctgtgctttctcctatttgtgaacctattggtggtgaatgtatgccacagttgtgttctgaagatatggatttgttgtgttatgaggcggcttttccctgtagcgactctgaaggtgagcaagacgaaaacggaatggcgcatgtttctgcagctgcagcggcggctgctgctaatagagaacgtgaggagtttcagttagaccatccggagttgcctggacatgattgtaagtcctgcgagtaccaccggaatagtactggaaacactgacttaatgtgctctttgtgttatctgcgagcctacagcatgtttatttacagtaagtgcgctatttggacggtgggaggtgtatttttttatttgttcttagcagtaaagacttttttgtttttaggtcctgtttctgacaacgaaccggaacctgacagcactacggatgacaatgagagaccgtcgcccccagaactgggagatgtagttccggaaggagtagtgaaacctgtacctcagcgggtgactgggaggcgacgtgctgtggaaagtattttggatttgatccaagaggaagaatgtgaacaaacagtgcctgttgatttgtcagtgaaacgccctaaatgtaattaa

SEQ ID NO: 334 - DNA, 156 bp, Artificial Sequence
  A31.orf00054 hypothetical protein
atgttttttgggcgttgttgtgtaagttttgtgtttttggcggtaaaagtgatttgcggaagtgaaaactgtttacgtcagttttattataggcgagtaatatttaccgagggcaaagtgaactttgagccactacgtggtggtttcgatacgtga

SEQ ID NO: 335 - DNA, 120 bp, Artificial Sequence; identical to SEQ ID NO: 228
  A31.orf00055 hypothetical protein

SEQ ID NO: 336 - DNA, 378 bp, Adenovirus B3
  MISC_FEATURE (1)..(378): B3.orf00001 E4 ORF1 protein
atggctgatgaggctttgtatgtctatttagagggaccgggagcaacgttgcctgaacagcagcagagaaataattatattttttattctcctgtgccttttactttgtatccgcgaggggtggctttgctatacttaaaattaagcataattatacccagaggctatgttggctgttttttctctttaactgatgctaacatgtctggattgtatgcttcatcaagaattattcatgctggccaccgcgaggaactttcggtgctgttgtttaatcacaatgacaggttttacgagggtcgagctggagaccctgtggcttgtcttgtgatggaaagactgatttttccacctgttcgacaggctactatgatatga

SEQ ID NO: 337 - DNA, 435 bp, Adenovirus B3
  MISC_FEATURE (1)..(435): B3.orf00002 E4 ORF2 protein
atgacgcttgtttcttttattttgcagactaattcaaaactaacaatgttggagcgcagcgcggtaacctattgtatttgcatcccaacggttttgaatgtttctttggaaaatttttcttttattcaatttttacaagaaactctgcctgattatatttccagcaactttgatgatattactggtggttcccagtatgcttattctaatcttgtttttgctggagccaattggggaggtctgcgcttgtactgcactgtagcgtcccctgctattgttcccggggggcttctggctaagcagtttggtgataatatgagagagtatctacaactagaacttagagaagaacttagagccaagggcatgtcaattgatgatgccattcttaatttgctacaggtgacacaggagcaagatattttgtcattatga

SEQ ID NO: 338 - DNA, 336 bp, Adenovirus B3
  MISC_FEATURE (1)..(336): B3.orf00003 E4 ORF3 protein
atggtggtggagggcgccctccgggacctgtttgtaatgtgtggtttggatttaccacaagaactgacacgaataattcaaggctggaaagctgaaaattatctgggaatggtgcaggaatgtaatatgatgtttgaggagttagaaaatgctccttcttttggtattcttttgtttttggatgtgcgcgtggaggctttgttggaagccaccgttgagcaccttgaaaatcgcatttcttttgatttagctgtgctttttcaccaacacagtgggggcgatagatgccatctgcgcgatctacaatttgaagtactgcgagatcgtttggaataa

SEQ ID NO: 339 - DNA, 900 bp, Adenovirus B3
  MISC_FEATURE (1)..(900): B3.orf00007 E4 ORF6 34-kDa
atgtcaggaagcaactccattatgacaaggttgcgcgcacgctccacatcatgcgccagacatcacccttacaccagagcccaattaccacgatgtgaggaaaatgaaacccgagcttctatgactgaagaccacccgctgttgccagattgtgatactatgactatgcatagtgtaagttgtgttcgtggtcttccttgttctgccagctttactgttctgcaagagtttcccattccttgggatatgtttttaaatccagaggagttaaaaattatgagaagatgcatgcatttatgtctttgttgtgctactatagatatttttcagtctcaagtgattcatggtcgagagaattgggttcttcattgtcattgtaatcagcagggttcacttcaatgcatggctgggggagcggtgttggcagtgtggttccggaaggttatattgggttgcatgattaaccaacgttgtccatggtacagacaaattgttaatatgcacatgccaaaagagatcatgtatgtgggtagtgtgtttttgagggaacgacatttaatttatattaaactttggtatgatggtcatgcaggggcgattatatcagatatgagttttggctggagcgcttttaattatggtttattaaacaatattgtgataatgtgctgtacctactgtagtaatctaagtgaaatcagaatgcgttgctgcgcgcatcgcaccagaaagttaatgttaagggctattaaaatcatgcttcaggacactgcggaccccgatcccataaacagcagtcgcacggagcgacgcagacagcggttgcttgtgggtttgatgagacacaatcgcccgattccgttttcggattatgattcccatcgttcttcttccagatga

SEQ ID NO: 340 - DNA, 252 bp, Adenovirus B3
  MISC_FEATURE (1)..(252): B3.orf00008 E4 ORF6/7 protein
atgaccgtgattcagactccggagtcgcatccgcaacagttggactgtgaaagcgctttaaaagactatcccgatgcatttttatgtattactgaccccagattggctcgctctgaaactgtttggaatgtggaatctaaaactatgtctatctctaatggtatccaaatgtttaaagctgtgcgtggggagagattggtgtattctgttaaatgggaagggggaggcaaaataactactcgaatactgtaa

SEQ ID NO: 341 - DNA, 960 bp, Adenovirus B3; identical to SEQ ID NO: 132
  MISC_FEATURE (1)..(960): B3.orf00009 L5 protein IV (fiber)

SEQ ID NO: 342 - DNA, 162 bp, Adenovirus B3
  MISC_FEATURE (1)..(162): B3.orf00010 U protein
atgaagattgtgggcaaagaagaggaaataaaatttgacatccctttcaaagtgtggagaaagtatgccaccctccgacgtttagagtaccagagttgggaagagggtgaggtgctgctggtagaaagttttgacaaagactgtattgctgatttcaagtaa

SEQ ID NO: 343 - DNA, 411 bp, Adenovirus B3
  MISC_FEATURE (1)..(411): B3.orf00011 E3B E3 15.3-kDa
atgactgacccaatcgccacatcatccaccgctgccaaggagctgctggacatggacggacgtgcctcagaacagcgactcatccaactacgcattcgtcagcagcaggaacgagcagtaaaagagctaagggatgccattgggattcaccagtgcaaaaaaggcatattctgcttagtaaaacaatccaaaatctcctacgagatcaccgctactgaccatcgtctctcatacgagctcggtccgcagcgacaaaaattcacctgcatggtgggaatcaaccccatagttatcacccagcagtctggagatactaagggttgtatccagtgttcctgtgattccaccgagtgcatctacacactgctgaagaccctctgcggccttcgagacctcctacccatgaactaa

SEQ ID NO: 344 - DNA, 438 bp, Adenovirus B3
  MISC_FEATURE (1)..(438): B3.orf00013 E3 14.9 kDa protein
atgttgcggcacttcttaggcttatttaaaaccatgcaggctatgctaccagtcattttaattttgctactaccctgcattcccctagcttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagaaccagatgaacatattccactacaacacatacaacaaccactagcactggtacagtatgaaaatgagccacaaccttcactgccccctgccattagttacttcaacctaaccggcggagatgactga

SEQ ID NO: 345 - DNA, 276 bp, Adenovirus B3
  MISC_FEATURE (1)..(276): B3.orf00015 E3 10.3 kDa protein
atgatccctagaaatttcttcttcaccatactcatctgtgcttttaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtgcgaattgcctacctacgtcaccatcccgaataccgcaatcaaaatgttgcggcacttcttaggcttatttaa

SEQ ID NO: 346 - DNA, 234 bp, Adenovirus B3
  MISC_FEATURE (1)..(234): B3.orf00017 E3B E3 9-kDa
atgatattgtttcaatcaaataccactacctcctatgcatacacaaacattcagcctaaatacgctatgcaactagaaatcacaatactaattgtaattggaattcttatactatctgttattctttattttatattctgccgtcaaatacccaatgttcatagaaattctaaaagacgtcccatctattctcctatgattagtcgtccccatatggctctgaatgaaatctaa

SEQ ID NO: 347 - DNA, 570 bp, Adenovirus B3
  MISC_FEATURE (1)..(570): B3.orf00019 E3B E3 20.5-kDa
atgatttccactacaatttttatcattactagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtacaaaattttcatgcaacggaagagacttgaccattattaacataacatcaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttccaaaaatcgctttaagtaattccacagccgctcccaatacaattcctaaatcaacaattggcatcattactgccgtggtagtgggattaatgattatatttttgtgtataatgtactacgcctgctgctatagaaaacatgaacaaaaaggtgatgcattactaaattttgatatttaa

SEQ ID NO: 348 - DNA, 540 bp, Adenovirus B3
  MISC_FEATURE (1)..(540): B3.orf00020 E3B E3 20.1-kDa
atggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaattaacagtgccaactatgacaataattaaaatggctaataaagcattagaaaattttacatcaccaacaacacccaatgaaaaaaacattccaaattcaatgattgcaattattgcggcggtggcattgggaatggcactaataataatatgcatgctcctatatgcttgttactataaaaagtttcaacataaacaggatccactactaaattttaacatttaa

SEQ ID NO: 349 - DNA, 519 bp, Adenovirus B3
  MISC_FEATURE (1)..(519): B3.orf00021 E3A E3 gp19-kDa
atgggggccatactagtcgtgcttgctttactttcgcttttgggtctgggctctgctaatctcaatcctctcgatcacgatccatgtttagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttccccagtggtatactgtctctgtccgaggtcctgacggttccatccgcattagtaacaacactttcattttttctgaaatgtgcgatctggccatgttcatgagcagacagtatgacctatggcctcccagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaa

SEQ ID NO: 350 - DNA, 321 bp, Adenovirus B3
  MISC_FEATURE (1)..(321): B3.orf00024 E3 11.7 kDa protein
atgtctaatggtggtgcggctgagctagctcgactgcgacacctagaccactgccgccgctttcgctgcttcgcccgggaactcaccgagttcatctacttcgaactctccgaggagcaccctcagggtccggcccacggagtgcggattaccatcgaagggggaatagactctcgcctgcatcgcatcttctcccagcggcccgtgctaattgaacgcgaccagggaaatacaaccatctccatctactgcatctgtaaccaccccggattgcatgaaagcctttgctgtcttgtttgtgctgagtttaataaaaactga

SEQ ID NO: 351 - DNA, 684 bp, Adenovirus B3
  MISC_FEATURE (1)..(684): B3.orf00025 L4 protein pVIII
atgagtaaagagattcccacgccttacatgtggagctatcagccccaaatggggttggcagcaggcgcttcccaggactactccacccgcatgaattggcttagcgccgggccctcaatgatatcacgggttaatgatatacgagcttatcgaaaccagttactcctagaacagtcagctctcaccaccacaccccgtcaacaccttaatccccgaaattggcccgccaccctggtgtaccaggaaaatcccgctcccaccaccgtactacttcctcgagacgcccaggccgaagttcagatgactaacgcaggtgtacagctggcgggcggttccgccctatgtcgtcaccgacctcaacagagtataaaacgcctggtgattagaggccgaggtatccagctcaacgacgagtcggttagctcttcgcttggtctgcgaccagacggagtcttccaaatcgccggctgtgggagatcttccttcactcctcgtcaggctgtgctgactttggagagttcgtcctcgcagccccgctcgggcggcattggaactctccagtttgtggaggagtttactccctctgtctacttcaaccccttctccggctctcctggccagtacccggacgagttcataccaaacttcgacgcaatcagcgagtcagtggatggctatgattga

SEQ ID NO: 352 - DNA, 297 bp, Adenovirus B3
  MISC_FEATURE (1)..(297): B3.orf00026 L4 33-kDa protein
gtgaccagaaaaccagcagttagaaaatccacaacaagtgcaccaggaggaggactgaggatcacagcgaacgagccagcgcagaccagagagctgaggaaccggatctttccaaccctctatgccattttccagcagagtcgggggcaagagcaggaactgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtag

SEQ ID NO: 353 - DNA, 2487 bp, Adenovirus B3
  MISC_FEATURE (1)..(2487): B3.orf00028 L4 100-kDa protein
atggaaactcagccatcactgccaacatcgctgcaagcaccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaaacggaagagattgaggcagatgtcgagcaggacccgggctatgtgacgccggcggagcaccaggaggagctgaaacgctttctagacagagaggatgacgaccgcccagagcatcaagcagatggcgtttaccaggaggctgggatcagggatcatgtcgccgactacctcaccggccttggtggggaggacgtgctcctcaaacatctagcaaggcagtcgatcatagttaaagacgcattgctcgatctcactgaagtgcccatcagtgtggaagagcttagccgcgcctacgagctgaacctcttttcgcctcaggtaccccccaagcggcagccaaacggcacctgcgaggccaaccctcgactcaacttctatccagcttttactatccccgaagtgttggccacctaccacatctttttcaagaaccaaaagattccagtctcctgccgcgccaaccgcacccgcgccgatgccctgctcaacttgggtccgggagctcgcttacctgatatagcttccttggaagaggttccaaagatctttgagggtctgggaagtgatgagacacgggccgcaaatgctctgcaacagggagagaatgacatggatgaacaccacagcgctctggtggaactggagggtgacaatgcccggattgcagtgctcaagcgcagtatcgtggtcacccattttgcctaccccgctgttaacctgccccccaaagttatgagcgctgtcatggaccatctgctcatcaaacgagcaagacctctttcagaaaaccagaacatgcaggatccagacgcctcggacgagggcaagccggtagtcagtgacgagcagctatctcgctggctgggtaccaactccccccgagatttggaagagaggcgcaagcttatgatggctgtagtgctagtaactgtggagctggagtgtctgcgccgctttttcaccgaccctgagaccctgcgcaagctagaggagaacctgcactacacctttagacatggcttcgtgcggcaggcatgcaagatctccaacgtggagcttaccaacctggtttcttacatgggcattttgcatgagaaccgactagggcagagcgtcctgcacaccacccttaaaggggaggcccgccgtgactacatccgagactgtgtctacctctacctctgccatacctggcaaactggtatgggtgtgtggcaacagtgtttggaagagcagaacctaaaagagctggacaagctcttgcagagatccctcaaagccctgtggacaggttttgatgagcgcaccgtcgcctcggacctggcagacatcatcttccccgagcgtctcagggttactctgcgaaacggcctgccagactttatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctgttccgcctggccaactacctctcctaccactcggatgttatagaggatgtgagcggagacggcctgctggaatgccactgccgctgcaatctttgcacaccccaccgctcccttgcctgcaacccccagttgctgagcgagacccagattatcggcaccttcgagctgcagggtcccagaagtaaaggcgaggggtcttctccggggcagagtttgaaactgacaccggggctgtggacctccgcctacctgcgcaagtttcaccccgaggactaccatccctatgagatcaggttctatgaggaccaatcacatcctcccaaagtcgagctctcagcctgcgtcatcacccagggagcaattctggcccaattgcaagccatccaaaaatctcgccaagaatttctgctaaaaaagggaaacggggtctaccttgaccctcagaccggtgaggagctcaacacaaggttcccccaggatgtcccatcgccgaggaagcaagaagttgaaggtgcagctgtcgcccccagaggatatgaaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtag

SEQ ID NO: 354 - DNA, 1554 bp, Adenovirus B3
  MISC_FEATURE (1)..(1554): B3.orf00031 E2A DNA binding protein DBP
atggccagccgcggaggaaatcagtcaagcgaccgccaccgggagcacacccccgaacgcggaatgagctctgccagccatccgcctccaaggccagaccgcagcccatctcagtcgcctccacctctgcccccgaagaggaacacctaccgtcgtgtggggtccggttcttctaccgagagccaggtggtattggtaagcgaaacttcgcagtcatccctgtctccggagcggagcaacagtcctcccccgatccctcccaagaagaagcccaggaagaccaagcatgtccctctgcaagacatcagccaggatagtgaagaagaaagagaacaggctcagttggtggccgtgggcttcagctaccccccggtgcgcatcattgagaaggatggcaagagaagtgttgagaagatcgacaagaatgaccctatagctaaaggagctacttttattgctgttaggaatcctttgagtctgcccctggtatctgcctgggagaagggcatggaagtgatggctgtgctaatggaaaggtacaggctggataatgatctgagaacctctttcaagctgatgccagagcagcacgagcaatacaagcgtatctgccaccagtatgtgaacgaggagcaccgtggcatcccgctgacatttaccagcatgaagaccttgacaacaatgatgggaagattcatgcagggattggtacattattattctgagatcgcccacaataattgggagtgcaccgggtgcgctctgtgggctcatggatgcaccgattatgaaggcaaggtgaaatgcctgcatggcactatcatgatccagaaggaccacattatcgagatggatgtggcgagcgagaacgggcagcgcgctatgaaggagaatccagacagagccaagatcacccaaaaccgctggggcagaaatgtggttcagttggccaacaacgatgcccgctgttgtgtgaatgatgccaactgtactactaatcaattttccagcaagtcctgtgggatgttctacaccgagggaagtaaggcccaggaagcttttaagcagtacgaagccttcatgaaggctgtgtacccagggataactcccgaccaagccaggatgatgctgatccccattcattgtgattgcaaccacaagccaggctgcgctcccgtgatgggcaggcagacatgtaagatgaccccctttgggatggccaatgctgaagacttggatgtgactaccatcagtgacccaaccgtgttggcaagcgtaagacacccagcgttgatagtgttccagtgttgcaacccagtgtatcgcaactcccgtgtccagaatgccggccccaactgtgatttcaagatctctgctcctgacctgcttggcgctatgcaactgaccagaaagttgtggcaagacacctttcccgagattccagttcccaagctggtaatccccgagttcaagtggcagaacaggttacagttccgcaacgtatccctgcccgcgggtcactctgactcccgccagaacccattcgacttctga

SEQ ID NO: 355 - DNA, 630 bp, Adenovirus B3
  MISC_FEATURE (1)..(630): B3.orf00033 L3 23-kDa protein (protease)
atgacatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctacaacacctgctacctttttgatccttttgggttctcggatgagcggctcaaacagatttaccagtttgagtacgaggggctcctgcgtcgcagtgcccttgctaccaaagaccgctgcatcaccctggagaagtctacccaaagcgtgcagggtccgcgctcagccgcctgtggacttttttgctgtatgttccttcatgcctttgtgcactggcccgaccgccccatggacggaaaccccaccatgaagttgctgactggggtgtccaacagcatgctccaatcaccccaagtccagcccaccctgcgccgcaaccaggaggtgctataccgcttcctaaacacccactcatcttactttcgttctcaccgcgcgcgcattgaaagggccaccgcgtttgaccgtatggatatgcaataa

SEQ ID NO: 356 - DNA, 2835 bp, Adenovirus B3; identical to SEQ ID NO: 192
  MISC_FEATURE (1)..(2835): B3.orf00036 L3 protein II (hexon)

SEQ ID NO: 357 - DNA, 132 bp, Adenovirus B3
  MISC_FEATURE (1)..(132): B3.orf00037 L3 hexon
atgtatgcccattggggcatcatcgatggggtggccatcttgaaagcaactcagcctcggcgcgcgacctcttcctttctcctctgctgcggcggcgtggtgatgatacatacacacagacaagcaagttaa

SEQ ID NO: 358 - DNA, 753 bp, Adenovirus B3
  MISC_FEATURE (1)..(753): B3.orf00038 L3 protein pVI
atggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatctggccaaccaggctgtacaaaaacagataaacagccgcctggacccgccgcccgcaacccctggtgaaatggaagtggaggaagaacttcctccgctggaaaagcggggcgacaagcgtccgcgacccgagctagagcagacgctggtgacgcgcgcagacgagcccccttcatatgaggaggcagtaaagctcggaatgcccactaccaggcctgtagctcacatggctaccggggtgatgaaaccttctcagtcacatcgacccgccaccttggacttgcctcctccccctgcttctgcggcgcctgttcccaaacctgtcgctaccagaaagcccaccgccgtacagcccgtcgccgtagccagaccgcgtcctgggggcacaccgcgcccgaaagcaaactggcaaagtactctgaacagcatcgtgggtctgggcgtgcagagtgtaaagcgccgtcgctgctattaa

SEQ ID NO: 359 - DNA, 228 bp, Adenovirus B3
  MISC_FEATURE (1)..(228): B3.orf00039 L2 protein pX
atggccctcacttgccgccttcgcgtccccattactggctaccgaggaagaaactcgcgccgtagaaggatgttggggcgagggatgcgccgccacagacgaaggcgcgctatcagcagacgattagggggtggctttttgccagctcttatacccatcatcgccgcagcgatcggggcgataccaggcatagcttcagtggcggttcaggcctcgcagcgccactaa

SEQ ID NO: 360 - DNA, 1050 bp, Adenovirus B3
  MISC_FEATURE (1)..(1050): B3.orf00041 L2 protein pV
atgtccaagcgcaaatacaaggaagagatgctccaggtcatcgcgcctgaaatctacggtccgccggtgaaggatgaaaaaaagccccgcaaaatcaagcgggtcaaaaataacaaaaaggaagaagatgacgatgatgggctggtggagtttgtgcgcgagttcgccccaagacggcgcgtgcagtggcgcgggcgcaaagtgcgtcaagtgctcagacccgggaccactgtggtttttacacctggcgagcgttccagcactacttttaaacggtcctatgatgaggtgtacggggatgacgatattcttgagcaggcggcagaccgccttgacgagtttgcttatggcaagcgcactagatccagtcccaaagaggaggctgtgtccattcctttggatcatggaaatcccacccccagcctcaaaccagtcaccctgcagcaagtgctgcccgtgcctgcgcggagaggcgtaaagcgcgagggtgaggacctatatcccaccatgcagctaatggtgcccaagcgccagaggctagaagacgtactggagaaaatgaaagtggatgccgatatccagcctgaggtcaaagtaagacctatcaaggaagtggcgccaggtttgggagtacaaaccttcgacatcaagattcccaccgagtccatggaagtgcagaccgaacctgcaaaacccaccacctcaattgaggtgcaaacggaaccctggatgcccgcgcccgttgccgcccccagcaccactcgaagatcacgacgaaagtacggcccagcaagtctgctaatgcccaactatgctctgcacccatccatcattcccactccgggttacagaggcactcgctactatcgaaaccggagcaacacctctcgccgccgcaaaccacctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaa

SEQ ID NO: 361 - DNA, 579 bp, Adenovirus B3
  MISC_FEATURE (1)..(579): B3.orf00044 L2 protein pVII
atgtccattctcatctcgcccagtaataataccggttggggactgtatgcgcccaccaagatgtatggaggcgcccgcaagcgctctacccagcatcctgtgcgcgttcgcggtcatttccgcgctccctggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcatcgccaggcgccacagggctactcccgccatgcgagccgcaaaagctattctgcggagggccaaacgtgtggggcgaagagccatgcttagagcggccagacgcgcggcttcaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcacccgcccccctcgcacttag

SEQ ID NO: 362 - DNA, 1635 bp, Adenovirus B3; identical to SEQ ID NO: 164
  MISC_FEATURE (1)..(1635): B3.orf00045 L2 protein III (penton)

SEQ ID NO: 363 - DNA, 1767 bp, Adenovirus B3
  MISC_FEATURE (1)..(1767): B3.orf00046 L1 protein pIIIa
atggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttctgccatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcaaaccaacctggaccggatggtgaccgatgtgcgcgaggccgtgtctcagcgcgagcgattccagcgcgacgccaacttggggtcgttggtagcgctaaacgctttcctcagcacccagcccgccaacgtgccccgtggtcagcaagactatacaaactttttgagtgcattgagactcatggtagctgaggtgccccagagcgaggtgtaccagtccgggccagattacttcttccagaccagcagacagggcttgcagacagtgaacctgactcaggctttcaagaacctgaagggtctgtggggagtgcacgccccagtaggggatcgcgcgaccgtgtctagcttgctgactcccaactcccgcctgctgctgctgctggtatccccctttactgacagcggtagcattgaccgcaactcgtacttgggctacctgcttaacctgtatcgcgaggccataggacagagccaggtggacgagcagacctatcaagaaatcacccaagtgagccgcgccctgggtcaggaagacacgggcagtttggaagccaccctgaacttcttgctaaccaaccggtcacagaagatccctcctcagtatgcgcttaccgctgaggaggagcggatcctcagatacgtgcaacagagcgttggactgttcctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtggacagcagcatattttccccgcctcccggttatacagtttggaagaaggaagggggcgatagaagacactcttccgtgtcgctatccggaacggctggtgctgccgcgaccgtgcccgaagctgcaagtcctttccctagcttgcccttttcactaaacagcgttcgcagcagtgaactggggagaataacccgcccgcgcttgatgggcgaggatgagtacttgaatgactctttgctgaggccagagagggaaaagaacttccccaacaatggaatagagagtctggtggataagatgagtagatggaagacctatgcgcaggatcacagagacgagcccaggatcttgggggctacaagcagaccgatccgtagacgccagcgccacgacaggcagatgggtcttgtgtgggacgatgaggactctgccgatgatagcagcgtgttggacttgggtggaagaggagggggcaacccgttcgctcatctgcgtcccagattcgggcgcatgttgtaa

SEQ ID NO: 364 - DNA, 1158 bp, Adenovirus B3
  MISC_FEATURE (1)..(1158): B3.orf00047 L1 52/55-kDa protein
atgcatccagtgctgcgacagatgcgcccccagcaacaggccccttctcagcaacagccacaaaaggctcttcttgctcctgcaactactgcagctgcagccgtgagcggcgcgggacagcccgcctatgatctggacttggaagagggcgagggattggcgcgcctgggggctccatcgcccgagcggcacccgcgggtgcaactaaaaaaggactctcgcgaggcgtacgtgccccagcagaacctgttcagggacaggagcggcgaggagccagaggagatgcgagcatctcgatttaacgcgggtcgcgagctgcgccacggtctggatcgaagacgggtgctgcaagacgaggattttgaggtcgatgaagtcacagggatcagcccagctagggcacatgtggccgcggccaacctagtctcggcctacgagcagaccgtgaaggaggagcgcaacttccaaaaatcttttaacaaccatgtgcgcaccctgatcgcccgcgaggaagtgaccctgggtctgatgcatctgtgggacctgatggaggctatcgcccaaaaccccactagcaaaccactgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtgaagatagatgggttttacatgcgcatgactctgaaggtgctgactctgagcgacgatctgggggtgtatcgcaatgacaggatgcaccgcgcggtgagcgccagcaggaggcgcgagctgagcgacagagaacttatgcacagcttgcaaagagctctaacgggggccgggactgatggggagaactactttgacatgggagcggatttgcaatggcaacccagtcgcagggccatggaggctgcagggtgtgagcttccttacatagaagaggtggatgaagtcgaggacgaggagggcgagtacttggaagactga

SEQ ID NO: 365 - DNA, 1923 bp, Adenovirus B3
  MISC_FEATURE (1)..(1923): B3.orf00049 E2B pTP
atgaactacttcatgccgctgcgcaacatctggaaccgcgtgcgcgagttcccacgtgcatccaccaccgcctccggtatcacctggatgtccaggtacatctacggctaccaccgcctcatgctggaagacctcgcccccggagccccggctacagagcgatggcccctgtaccgccagccaccgccacactttctcattggctaccagtacctggtgcgcacctgcaacgattacatctttgacacccgcgcatactcgcgcctcaagtacaccgagctcgtgcgccctgggcaccagacagtcaactggtcagtcatggccaactgctcctacacaatcaacaccggggcctaccaccgcttcgtggactttgacgacttccaagccaccctcacccaggtgcagcaagccatcctcgccgaaagggttgtagcggacctggcacttgtccagcccatgcgcgggttcgggatcactcgcatgcatggcagagcgggcgaagaagaagtgcccgtggaacgactcatgcaagactactataaagatctggccagatgtcaggataatgcttggggaatggctcatcgcctgcgtatccaacaagccggacccaaagacctggtgctcctcgccaccatccgccgtctcaaaactgcctattttaatttcatcaccagcagcatcgtctcaccctcccaagaggaggaaggagaagaaagagagaaccccgaccgagcgtctagccgcccccgcccgcaagaaacagtgctcagcctaccttgcgattgcgactggttagacgctttcgtcgaaaggttttcagatcccgtggatcttgagacgatcaggtccttgcgcggagtacctacggggcaattgataaaatgcataatcagcgcggtgtccctgcccaacggagagcctcccagtcaccacttcagggagatgcgcggaggcgtcttcactctgagacccagggagaacggtcgtgccgtcaccgagaccatgcgccgccgccgcggagaggtcattgaaagattcatcgaccgtctgcccgtgcgccgccggcgtcgccgcgttccccctcctcctgcagccccacctgaagaggaagagatgttagtggaagaagaagagattgaggaagaaatcccaggggctttcgagcgcgaggtgcgcaccaccatcgccgaacttatccgtcttctggaagaggagttgaccgtgtccgcgcgtaactcccagttttttaactttgccgtggacttctacgaggccatggagcgcttggaagcgctgggcgatgtcagcgagatgccgctgagacgatggatcatgtatttcttcgtcaccgagcacatcgccaccacactcaactaccttttccagcgcctatgcaactatgcggtcttcacccgccacgtggagctcaacctcgcccaggtggtcatgcgcgcgagagatcccgtgggggctgtggtctacagccgcgtctggaacgaggcgggcatgaatgcattctctcaactcattgggcgcatctccaacgacctcgcggccaccgtcgagagagcgggccgcggagatcttcaagaggaagagatcgagcagttcatggccgagatcgcctaccaggacaactctggcgacgtgcaagaaatccttaggcaagccgccgtcaacgataccgagattgattctgttgaactctctttcaggttcaagctcacggggccggtagctttcacccagaggcgtcagatccaggatgtcaaccgccgcgtcgtcgcgcatgcgagtcttctcagggcgcagtaccagaacctacccgcgcgcggcgccgacgtaccactgccagccatgccgccgggtcccgagccgcccctgccgcccggtgcgcgccctcgacaccgcttctaa

SEQ ID NO: 366 - DNA, 3369 bp, Adenovirus B3
  MISC_FEATURE (1)..(3369): B3.orf00050 E2B DNA polymerase
atgcaagaagcaacagagccaccgccgtccaaaatgaaaaacaagggcacggtggtagcgcccaagggacacggaaccctgcaagccatcgacatctccaccaacggacccgttgagatcaagtactatctgaacctccctcacgccctccaaaagatcatgcaagttaatctcctgacactgcctactaacctgactccgcagcgtctcaggaccctggacagctccggcctgcgcgctctcgtcctcgagctccgcccctgccgcgccgaggtctggacttgcctcccgcgagggctcgtcagcatgaccaccatcgagacagaagatggtcatgccgatgcagacaacatagtaaagcgcgaggtacaagcgccaggcctcaattttccactgaaatttctcgtcaaaggaagtcaggtacaactcattcataaggtgcatcccgtgaatcgctgcgagtactgcggccgtctgtacaagcacaagcatgaatgctcggcgcgtcgcagggagttctacttccatcacatcaacagccattcctccaactggtggcaggagatccagttcttcccgattggctctcatcctcgcacagaaaggctctttctcacctacgatgtggaaacctacacctggatggggtcctttggcaagcagctaatccccttcatgctggtcatgaaactctctggagaccagcggctcgtcaacatcgcctatgacctcgccataaaactcaagtgggatcgctggcggcaggacccccaaaccttctattgcgtcaccccagaaaagatggcagtcggacagcattttcgtcagtaccgggaccagttacaaacagcactggcagtggacctctggtcctccttccttaaagcgaaccctcacgtgcacgaatgggccctcgaacactatgctctcactgaccctacagatctcacttttgaagaactcaagaagctgcctcatgtcaggggcacccctcgattcttagaactgtacatagtggggcacaacatcaatggctttgatgagatcgtcttggccgctcaggttatcaataaccgagcagaggttcctcagcctttcaaaatcacccgaaatttcatgcccagggccggcaagatcctcttcaatgatgttactttcgctttgcccaaccccgcctacaagaagcgggtggacttccaactctgggaacagggggcctgtgatgacatcgacttcaagtatcaattcctcaaagtcatggtcagggacacttttgccctcactcatacctcgctgcgcaatgcagcccaagcatactctctcccagtggagaagggatgctgtccctacaaggcagtcaatcagttctacatgttgggctcttaccgtgcagaaaaagacgggtttcccctcgaagagtactggaaggatcacgaagaataccttctcaaccgcgagctgtgggaaaagaaaagccaaccgcgttatgacatcatccaggaaactctcgactactgtgccctggatgtactcatcaccgccgagctggtagccaagctgcaagagtcatatgcccacttcataagggactctgtaggcttacctcatgcccattttaacatattccagagacctactatctcttccaattcccatgccatctttcgccagatcgtttacagggcggaaaaacccaaccgcaccaatctgggcccgggtcttcttgccccctcacatgaactctatgactatgtgcgagcaagcatcagaggggggcgatgttatcccacttacatcggcatcctcgaagagcccctctatgtctacgatatctgtggcatgtatgcctccgcgctcacccaccccatgccctggggcacccctcttaacccctatgagcgcgcgctggcagttcgagaatggcagatgaccttggatgatcccgccaccatcagctattttgacaaagatttgctaccgggaatatttaccatagatgcggacccccctgatgagttcatgctagaccccctcccccctttctgttcaagaaaaggaggtcgactctgctggaccaatgagcccctccgaggcgaggtggccaccagtgtggatctgataaccctgcacaataggggatggcgaatcagaatagttccggatgaactgacaaccatctttcctgaatggaaatgtgtggcgcgcgagtacgtccagcttaacatcaccgccaaggagcgcgcggacaaggaaaagaaccaaaccatgcgctccatcgccaagcttctatccaatgccctctatggatcatttgccaccaagctggacaacaagaagattgtgttttctgaccagatggacgagagtcttatgaaaggcatctctgctggtactgtcaatatcaaatcctcctcgttcctagaaactgacaacctgagtgcagaggtcatgcccgccttcgagagggaatacctaccccaacagctggcgctcctggacagcgatccggaagacagtgaggacgaacagaggcccgcccccttttatacccccccggcggggacccctggtcacgtggcctacacttacaagccaatcacattcttggatgtggaggagggggacatgtgtttacataccgtagagaaggtggaccccctggttgacaacgaccgctacccctcccacgtggcctcctttgtgctggcctggacacgcgcttttgtatcagagtgggctgggttcctctacgaagaggaccgaggcactccgctcgaggacaggcccataaagtcggtctacggggacacggacagcctctttgtcacccagcggggacacgaactcatggaaaccaaaggtaagaaacgcatcaaaaaacatggcggaaaacttgtttttgaccccgatgagccggatctgacctggctcgtggagtgcgaaaccgtctgcgcctcctgcggtgcggatgcatactcccccgaatccattttcctcgcgcccaagttgtatgccctcaaatgtatctactgccccgcctgccataaaacttccaaaggtaagctccgtgccaaaggccacgcggccgaggcgctcaactacgaactcatggtaaactgctacctggccgacatgcagggcgccaatcggcagcggttctcgaccagcaggatgagtctgaagcgcaccctcgcaagcgcccaaccaggcgcgcaccccttcaccgtgacggaaacaaccctgactcggacgctgcgaccatggaaggatcggaccctggcagcgctggacgcccatcgtctgattccctactccaggagccgtcccaacccgcgaaacgaggaggtctgctggatcgagatgccatag

SEQ ID NO: 367 - DNA, 1047 bp, Adenovirus B3
  MISC_FEATURE (1)..(1047): B3.orf00051 IVa2 protein IVa2
atgcccatggctgacgggctgaagccgctgaaaaacttctcctcgctccaggagcttctatcccttgggggagagcgcctcctaacggacttggtgcgggaaaatatccatgtaagggaaatgatgaacgaagtggcccccctgctccgggaggacggcagctgtcgttccctaaactaccatctgcaacccgtaattggggtcatttacggtcccactgggtgcggcaagtctcagctgcttaggaatttgctctcgtcccagttaatcaccccggctccagaaacggtattttttatagccccgcaggtggacatgatccccccctctgaactgaaagcctgggaaatgcaaatatgtgagggaaactatgctcccgggccagagggaactttcatcccccaatctggcaccctccgcccaaagtttattaaaatggcttatgatgacctgactcaggagcataactatgatgtttcagacccccggaacgtgttcgcccgtgccgctgcccacggccccatcgctatcattatggatgagtgcatggagaatctggggggtcacaaaggcgtctccaaattttttcatgcttttccctctaagctgcatgataaatttcccaagtgcaccggatacactgtcttggtggtcctgcacaatatgaacccgagacgggatctaggcggcaacattgccaacctcaagatccagtccaaaatgcatataatttcaccccggatgcacccgtcccagctcaacagatttgtaaacacctacactaagggcctccccgttgcaattagtctgctcctaaaagatattgtgcaacaccatgcactccgaccttgctatgactgggtgatttataacactaccccggagcaagaggctcttcaatggagctatctccacccccgagacggactaatgcccatgtatctaaacattcaatcccacctttacagggtactggaaaagatccaccgcgttctcaatgatcgagaccgatggtccagggcataccgcgcgcgaaaaatcaaataa

SEQ ID NO: 368 - DNA, 417 bp, Adenovirus B3
  MISC_FEATURE (1)..(417): B3.orf00053 IX hexon-associated protein IX
atgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattatggaagcatcgttgccaattccagttcctctaataacccttcaaccctggctgaggacaagctacttgttctcttggcgcagctcgaggccttaacccaacgcttaggcgaactgtctaagcaggtggcccagttgcgtgagcaaactgagtctgctgttgccacagcaaagtctaaataa

SEQ ID NO: 369 - DNA, 1122 bp, Adenovirus B3
  MISC_FEATURE (1)..(1122): B3.orf00054 E1B 55-kDa
atgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagtttttagatgttgtatgatgggtatgtggccaggggttgtcggcatggaagcagtaacacttatgaatattaggtttaaaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcggatgagaggccttatcagatgctgacctgcgctggtggacattgcaatattcttgctaccgtgcatatcgtttcacatgcacgcaaaaaatggcctgtatttgaacataatgtgattaccaagtgcaccatgcacataggtggtcgcaggggaatgtttatgccttaccagtgtaacatgaatcatgtgaaggtaatgttggaaccagatgccttttccagagtgagcttaacaggaatctttgatatgaatattcaactatggaagatcctgagatatgatgacactaaaccaagggtgcgcgcatgcgaatgcggaggcaagcatgctagattccagccggtgtgcgtggatgtgactgaagacttgagacccgatcatttggtgcttgcctgcactggagcggagttcggttctagtggtgaagaaactgactaa

SEQ ID NO: 370 - DNA, 537 bp, Adenovirus B3
  MISC_FEATURE (1)..(537): B3.orf00055 E1B 21-kDa
atggaggtttgggctatcttggaagacctcagacagactaagctactgctagaaaacgcctcggacggagtctctggcctttggagattctggttcggtggtgatctagctaggctagtgtttaggataaaacaggactacagggaagaatttgaaaagttattggacgatagtccgggactttttgaagctcttaacttgggtcatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctgggagtagcagggatactgagacacccaccgaccatgccagcggttctgcaggaggagcagcaggaggacaatccgagagccggcctggaccctccggtggaggagtag

SEQ ID NO: 371 - DNA, 201 bp, Adenovirus B3
  MISC_FEATURE (1)..(201): B3.orf00056 E1A mRNAII protein
gtgtctgatgatgagtcaccttctcctgattcaactacctcacctcctgaaattcaggcgcccgcacctgcaaacgtatgcaagcccattcctgtgaagcctaagcctgggaaacgccctgctgtggataagcttgaggacttgttggagggtggggatggacctttggaccttagtacccggaaactgccaaggcaatga

SEQ ID NO: 372 - DNA, 594 bp, Artificial Sequence
  B3.orf00058 E1A hypothetical protein
atgagacacctgcgcttcctgccacaggaggttatctccagtgagaccgggatcgaaatactggagtttgtggtaaataccctaatgggagacgacccggaaccgccagtgcagcctttcgatccacctacgctgcacgatctgtatgatttagagatagacgggccggaggatcccaatgaggaagctgtgaatgggttttttactgattctatgctgctagctgctgatgaaggattggacataaaccctcctcctgagacacttgttaccccaggggtggttgtggaaagcggcataggtgggaaaaaattgcctgatctgggagcagctgaaatggacttgcgttgttatgaagagggttttcctcccagtgatgatgaagatggggaaactgagcagtccatccataccgcagtaaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaa

SEQ ID NO: 373 - DNA, 378 bp, Adenovirus B7
  MISC_FEATURE (1)..(378): B7.orf00001 E4 ORF1 protein
atggctgatgaggctttgtatgtgtatttagagggaccaggggcgatgttgcctgaacagcagcagagaaataattatattttttattctcctgtgccttttactttgtatccgcgaggggtggctttgctaaacttaaaattaagcataattatacccagaggctatgttggctgttttttctctttaactgatgctaacatgtctggattatatgcttcatcaagaattattcatgctggccaccgcgaggaactttcggtgctgttgtttaatcacgatgacaggttttacgagggtcgagctggagaccctgtggcttgtcttgtgatggaaagactgatttatccacctgttcgacaggctactatgatatga

SEQ ID NO: 374 - DNA, 435 bp, Adenovirus B7
  MISC_FEATURE (1)..(435): B7.orf00002 E4 130aa protein
atgacgtttgtttcttttattttacagactaattcaaaactaacaatgttggagcgcagcgcggtaacctattgcatttgcatcccagaggttttgaatgtttttttggaaaatttttcttttattcaatttttacaagaaactctgcctgattatatttccagcaactttgatgatattactggtggttcccagtatgcttattctaatcttgtttttgctggagccaattggggaggtctgcgcttgtactgcactgtagcgtcccctgctattgttcccggggggcttctggctaagcagtttggtgataatatgagagagtatttacaactagaacttagagaagaacttagagccaagggcatatcaattgatgatgccattcttaatttgctacaggtgacacaggagcaagatattttgtcattatga

SEQ ID NO: 375 - DNA, 354 bp, Adenovirus B7
  MISC_FEATURE (1)..(354): B7.orf00003 E4 ORF3 protein
atgagggtgtgtttaagaatggtggtggagggcgcccttcgggacctgtttgtaatgtgtggtttggatttaccacaagaactgacacgaataattcaaggttggaaagctgaaaattatctgggaatggtgcaagaatgtaatatgatgtttgaggagttagaaaatgctccttcttttggtattcttttgtttttggatgtgcgcgtggaggctttgttggaagccaccgttgagcaccttgaaaatcgcatttcttttgatttagctgtgctttttcaccaacacagtgggggcgatagatgccatctgcgcgatctacaatttgaagtactgcgagatcgtttggaataa

SEQ ID NO: 376 - DNA, 900 bp, Adenovirus B7
  MISC_FEATURE (1)..(900): B7.orf00006 E4 ORF6 34-kDa
atgtcaggaagcaactccattatgacaaggttgcgcgcgcgctcgacatcttgcgccagacatcacccttacaccagagcccagttaccacgatgtgaggaaaatgaaacccgagcttctatgactgaagaccacccgctgttgccagattgtgatactatgactatgcatagtgtaagttgtgttcgtggtcttccttgttctgccagctttactgttctgcaagagtttcccattccttgggatatgtttctaaatcccgaggagttaagaattatgagaagatgcatgcatttatgtctttgttgtgctactatagatatttttcattctcaagtgattcatggtcgagaaaattgggttcttcattgtcattgtaatcggcagggttcacttcaatgcatggctgggggagcggtgttggcagtgtggtttcggaaggttatattgggttgcatgattaaccaacgttgtccatggtacagacagattgttaatatgcacatgccaaaagagattatgtatgtgggtagtgtgtttttgagggaacgacatttaatttatattaaaatttggtatgatggtcatgcaggggcgattatatctgatatgagttttggctggagcgcttttaattatggtttattaaacaatattgtgataatgtgctgtacctactgtagtaatctaagtgaaatcagaatgcgttgctgcgcgcaccgcaccagaaagttaatgttaagggctattaaaatcatgcttcaggacactgtggatcccgatcctataagcagcagtcgcacggagcgacgcagacagcggctgcttgtgggtttgatgagacacaatcgcccgattccgttttcggattatgattcccatcgttcttcttccagatga

SEQ ID NO: 377 - DNA, 252 bp, Adenovirus B7
  MISC_FEATURE (1)..(252): B7.orf00007 E4
atgaccgtgatccagaccccggagtcgcatccgcagcagttggactgtgaaagcgctttaaaagactatcccgatgcatttttatgtatcactgaccccagattggctcgctttgaaactgtttggaatgtggaatctaaaactatgtctatctgtaatggtatccaaatgtttaaagctgtgcgtggggagagattggtgtattctgttaaatgggaagggggaggcaaaataactactcgaattttatga

SEQ ID NO: 378 - DNA, 978 bp, Adenovirus B7; identical to SEQ ID NO: 133
  MISC_FEATURE (1)..(978): B7.orf00008 L5 fiber protein

SEQ ID NO: 379 - DNA, 165 bp, Adenovirus B7
  MISC_FEATURE (1)..(165): B7.orf00009 U protein
atgaagattgtgggtacaggagaggagttaaaatttgacatcccctttaaagtatggagaaagtatgccgctgaacggggtttagaataccagagttgggaagagggaagtgaggtgctgctgggagaaaatttcaacagagaccttattgctgatttcaagtaa

SEQ ID NO: 380 - DNA, 408 bp, Adenovirus B7
  MISC_FEATURE (1)..(408): B7.orf00011 E3 15.3 kDa protein
atgactgaaatactcaccacctccaattccgccgaggatctgcttgatatggacggccgcgtctcagaacagcgactcgcccaactacgcatccgccagcagcaggaacgcgtgaccaaagagctcagagatgtcatccaaattcaccaatgcaaaaaaggcatattttgcttggtaaaacaagccaaaatatcctacgagatcaccgctactgaccatcgcctctcttacgaacttggcccccaacgacaaaaatttacatgcatggtgggaatcaaccctatagttatcactcagcaaagtggagatactaaggggtgcattcactgctcttgtgattccatcgagtgcacctacaccctgctaaagaccctatgcggcttaagagacctgctacccatgaattaa

SEQ ID NO: 381 - DNA, 405 bp, Adenovirus B7
  MISC_FEATURE (1)..(405): B7.orf00012 E3 14.9 kDa protein
atgcaggctatgctaccagtcattttaattctgctactaccctgcattgccctagcttccaccgccactcgcgctacacctgaacaacttagaaaatgcaaatttcaacaaccatggtcatttcttgattgctaccatgaaaaatctgatttccccacatactggatagtgattgttggaataattaacatactttcatgtacatttttctcaatcacaatataccccacatttaattttgggtggaattctcccaatgcactgggttacccacaagaaccagatgaacatattccactacaacacatacaacaaccactagcactggtagagtatgaaaatgagccacaaccttcactgcctcctgccattagttacttcaacctaaccggcggagatgactga

SEQ ID NO: 382 - DNA, 276 bp, Adenovirus B7
  MISC_FEATURE (1)..(276): B7.orf00013 E3 10.3 kDa protein
atgatccctagaaatttcttcttcaccatactcatctgtgctttcaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtacgaattgcctacctacgtcaccatcccgaataccgcaatcaaaatgttgcggcacttcttaggcttatttaa

SEQ ID NO: 383 - DNA, 201 bp, Adenovirus B7
  MISC_FEATURE (1)..(201): B7.orf00016 E3 7.7 kDa protein
atgatattgtttcaatcaaataccactaacactatcaatgtgcagactactttaaatcatgacatggaaaaccacactacctcctatgcatacataaacattcagcctaaatacgctatgcatctaaaaatcaccatactaattgtaattggaattcttatactatctgttattctttattttctattctcctatgattag

SEQ ID NO: 384 - DNA, 570 bp, Adenovirus B7
  MISC_FEATURE (1)..(570): B7.orf00018 E3 20.3 kDa protein
atgatttccactacaatttttatcattactagccttgcggctgtaacttatggccgttcacacctaactgtacctgttggctcaacatgtacactacaaggaccccaacaaggctatgtcacttggtggagaatatatgataatggagggttcgctagaccatgtgatcagcctggtacaaaattttcatgcaacggaagagacttaaccataattaacataacatcaaatgagcaaggcttctattatggaaccaactataaagatagtttagattacaacattattgtagtgccagccaccacttctgctccccgcaaaaccactttctctagcagcagtgccaaagcaagcacaattcctaaaacagcttctgctatgttaaagcttcaaaaaatcgctttaagtaattccacagccgctcccaaaacaattcctaaatcaacaattggcatcattactgccgtggtagtgggattaattattatatttttgtgcataatgtactatgcctgctgctatagaaaacatgaacaaaaaggtgatgcattactaaattttgacatttaa

SEQ ID NO: 385 - DNA, 540 bp, Adenovirus B7
  MISC_FEATURE (1)..(540): B7.orf00019 E3 20.1 kDa protein
atggctactgttacagctctaattattgccagcattgtcactgtcgctcacgggcaaacaattgtccatattaccttaggacataatcacacccttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaatcaacagtgccaactatgacaataattaaaatggctaataaagcattagaaaattttacatcaccaacaacgcccaatgaaaaaaacattccaaattcaatgattgcaattattgcggcggtggcattgggaatggcactaataataatatgcatgttcctatatgcttgttgctataaaaagtttcaacataaacaggatccactactaaattttaacatttaa

SEQ ID NO: 386 - DNA, 519 bp, Adenovirus B7
  MISC_FEATURE (1)..(519): B7.orf00020 E3 19 kDa MHC class I antigen-binding glycoprotein
atgggggccatattagtcgtgcttgctttactttcgcttttgggtctgggctctgctaatctcaatcctcttgatcacgatccatgtctagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttcccgagtggtatactgtctctgtccgaggtcctgacggttccatccgcattagtaacaacacttttattttttctgaaatgtgcgatctggccatgttcatgagcagacagtatgacctatggcctcccagcaaagagaacattgtggcattttctattgcttattgcttggtaacatgcattatcactgctatcatttgtgtgtgcatacacttgcttatagttattcgccctagacaaagcaataaggaaaaagagaaaatgccttaa

SEQ ID NO: 387 - DNA, 441 bp, Adenovirus B7
  MISC_FEATURE (1)..(441): B7.orf00022 E3 16.1 kDa protein
atgaaagcctttgctgtcttgtttgtgctgagtttaataaaaactgagttaagaccctcctacggactaccgcttcttcaatcaggactttacaacaccaaccagatcttccagaagacccagacccttcctcctctgatccaggactctaactctaccttaccagcaccatccactactaaccttcccgaaactaacaagcttggatctcatctgcaacaccgcctttcacgaagccttctttctgccaatactaccactcccaaaaccggaggtgagctccgcggtctccctactgacgacccctgggtggtagcgggttttgtaacgttaggagtagttgcgggtgggcttgtgttaatcctttgctacctatacacaccttgctgtgcatatttagtcatattgcgctgttggtttaaaaaatgggggccatattag

SEQ ID NO: 388 - DNA, 321 bp, Adenovirus B7
  MISC_FEATURE (1)..(321): B7.orf00023 E3 12.1 kDa glycoprotein
atgtctaatggtggcgcggctgagctagctcgactgcgacacctagaccactgccgccgctttcgctgcttcgcccgggaactcaccgagttcatctacttcgaactccccgaggagcaccctcagggtccggcccacggagtgcggattaccatcgaagggggaatagactctcgcctgcatcgaatattctcccagcgacccgtgctgattgagcgcgaccagggaaatacaaccatctccatctactgcatctgtaaccaccccggattgcatgaaagcctttgctgtcttgtttgtgctgagtttaataaaaactga

SEQ ID NO: 389 - DNA, 684 bp, Adenovirus B7
  MISC_FEATURE (1)..(684): B7.orf00024 L4 protein VIII
atgagtaaagagattcccacgccttacatgtggagctatcagccccaaatggggttggcagcaggcgcctcccaggactactccacccgcatgaattggcttagcgccgggccctcaatgatatcacgggttaatgatatacgagcttatcgaaaccagttactcctagaacagtcagctctcaccaccacaccccgccaacaccttaatccccgaaattggcccgccgccctggtgtatcaggaaactcccgctcccaccaccgtactacttcctcgagacgcccaggccgaagttcatatgactaacgcaggtgtacagctggcgggcggttccgccctatgtcgtcaccgacctcaacagagtataaaacgcctggtgatcagaggccgaggtatccagctcaacgacgagtcggttagctcttcgcttggtctgcgaccagacggagtcttccaaatcgccggctgtggaagatcttccttcacccctcgtcaggctgtactgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattga

SEQ ID NO: 390 - DNA, 297 bp, Adenovirus B7
  MISC_FEATURE (1)..(297): B7.orf00025 L4 33 kDa protein
gtgaccagaaaaccagcagttagaaaatccacaacaagtgcagcaggaggaggactgaggatcacagcgaacgagccagcgcagaccagagagctgaggaaccggatctttccaaccctctatgccatcttccagcagagtcgggggcaagagcaggaactgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtag

SEQ ID NO: 391 - DNA, 2487 bp, Adenovirus B7
  MISC_FEATURE (1)..(2487): B7.orf00028 L4 100 kDa hexon-assembly associated protein
atggaaactcagccatcactgccaacatcgctgcaagcgccatcacacctcgcccccagcagcgacgaggaggaaagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaagcagatggcgatcaccaggaggctggcatcggggatcatgttgccgactacctcaccgggcttgggggggaggacgtgctcctcaaacatctagcaaggcagtcgaacatagttaaagacgcactactcgacctcaccgaagtgcccatcagtgtggaagagcttagccgcgcctacgagctgaacctcttttcgcctcagataccccccaagcggcagccaaacggcacctgcgaggccaaccctcgactgaacttctatccggcttttactgtccccgaagtgctggccacctaccacatcttttttaagaaccaaaagattccagtctcctgccgcgccaaccgcacccgcgccgatgcccttctcaacttgggtccgggagctcgcttacctgatatagcttccttggaagaggttccaaaaatctttgagggtctgggaagtgatgagactcgggccgcaaatgctctgcaacagggagagaatggcatggataaacatcacagcgctctagtggaactggagggtgacaatgcccggcttgcagtgctcaagcgcagtatcgtggtcacccattttgcctaccccgctgttaacctgccacccaaagtcatgagcgctgtcatggaccatctgctcatcaaacgagcaagtccactttcagaaaaccagaacatgcaggatccagacgcctcggacgatggcaagccggtagtcagtgacgagcagctatctcgctggctgggtaccaactccccccgagatttggaagaaaggcgcaagcttatgatggctgtagtgctagtaactgttgagctggagtgtctgcgccgcttttttaccgaccccgagaccctgcgcaaactagaggagaacctgcactacaccttcagacatggcttcgtgcgccaggcatgcaagatttccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaacctcaaagaactggacaagctcttgcagagatcccttaaagccctgtggacaggttttgacgagcgcaccgtcgcctcggacctggcggacatcatcttccccgagcgtcttagggttactctgcgaaacggcctgccagacttcatgagccagagcatgcttaacaactttcgctctttcatcctggaacgctccggtatcctgcctgtcacctgttgtgcgctgccctccgactttgtgcctcttacctaccgcgaatgcccaccgccgctatggagccactgctacctgttccgcctggccaactacctctcctaccactcggatgtgatagaggatgtgagcggagacggcctgctggaatgccactgccgatgcaatttatgcacaccccaccgctccctcgtctgcaacccacagttgctaagcgagacccagatcatcggcaccttcgagttgcagggtcccaacagtgaaggcgaggggtcttctccgggtcatagtctgaaactgacaccggggctgtggacctccgcctacctgcgcaagtttcatcccgaggactaccacccctatgagatcaggttctatgaggaccagacacatcctcccaaagtcgagctctcagcctgcgtcattacccagggagcaattctggcccaattgcaagccatccaaaaatcccgccaagaatttctgctaaaaaagggaagcggggtctaccttgacccccagaccggtgaggagctcaacacaagattcccccaggatgtcccatcgccgaggaagcaagaagctgaaggtgcagctgtcgcccccagaggatatgaaggaacactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggagcccagcggcggcccaacagtag

SEQ ID NO: 392 - DNA, 1554 bp, Adenovirus B7
  MISC_FEATURE (1)..(1554): B7.orf00032 E2A DNA binding protein
atggccagccgcggaggaaatcagtcaagcgaccgccaacgggagcacacccccgaacgcggaatgggctctgccagccatccgcctccaaggccagaccgcagcccatctcagtcacctccacctctgcccccgaagaggaacacctaccgtcgcgtggggtccaattcttctatcgagagccaggtggtactggtaagcgaaacttcgcggtcatccctgtctccggaacggagcaacagtcctcccccaatccctcccaagaagaagcccaggaagaccaagcatgtccctctgcaagacatcagccaggacagcgaagaagaaagagaacaggttcagttggtggccgtgggcttcagctaccccccggtgcgcatcattgagaaggatggcaagaggagtgttgagaagatcgacaataatgatcctatatctaaaggagctacttctattgctgttaggaatcctttgagcttgcccctggtatctgcctgggagaagggcatggaagtgatggctgtgctaatggagaggtacaggctggataatgacctgagaacctctttcaagctgatgccagagcagcacgagcagtacaagcgtatctgccaccagtatgtgaacgaggagcaccgcggcatcccgctgacatttagtagcatgaagaccctgacagcgatgatgggaagattcatgcagggattggtgcattcttattctgagatcgcccacaataattgggagtgcaccgggtgcgctctgtgggctcatggatgcaccgattacgaaggcaaggtgaaatgcctgcatggcactatcatgatccagaaggaccacattatcgagatggatgtggcgagcgagaacgggcagcgcgctatgaaggagaacccagacagagccaagatcacccagaaccgctggggcagaaatgtggtccagttggccaacaacgatgcccgctgctgtgtgaatgatgccaactgtgctactaaccaattttccagcaagtcctgtgggatgttctacaccgagggaattaaggctcaggaagctttcaagcagtacgaagccttcatgaaggccgtgtacccagggataacccccgaccaagccaggatgatgctgatccccattcattgcgattgcaaccacaagccaggctgtgctcccgtgatgggcaggcagacctgtaagatgaccccctttgggatggccaatgctgaagacttggatgtggctaccatcagtgacccgaccgtgctggcaagcgtgagacacccagccttgatggtgttccagtgttgcaacccagtgtaccgaaactcccgtgtccaaaatgccggccccaactgtgatttcaagatctctgctcctgacctgcttggcgccctgcaactgaccagaaagttgtggcaagacacctttcccgagattccagttcccaagctggtgatacccgagttcaagtggcagaacaggttacagttccgcaacgtatccctgcccgcgggtcactatgactcccgccagaatccatttgacttctga

SEQ ID NO: 393 - DNA, 630 bp, Adenovirus B7
  MISC_FEATURE (1)..(630): B7.orf00033 L3 23 kDa protein
atgacatgcgggtccggaaacggctccagcgagcaagagctcaaagccatcgtccgagacctgggctgcggaccctatttcctgggaacctttgacaagcgtttcccggggttcatggcccccgacaagctcgcctgtgccatagtcaacactgccggacgcgagacggggggagagcactggctggcttttggttggaacccgcgctccaacacctgctacctttttgatccttttgggttctcggatgagcggctcaaacagatttaccagtttgagtacgaggggctcctgcgccgcagtgcccttgctaccaaaaaccgctgcatcaccctggagaagtccacccaaagcgtgcagggtccgcgctcagccgcctgtggacttttttgctgtatgttccttcatgcctttgtgcactggcccgaccgccccatggacggaaaccccaccatgaagttgctgactggggtgtccaacagcatgctccaatcaccccaagtccagcccaccctgcgccgcaaccaggaggcgctatatcgcttcctaaacacccactcatcttactttcgttctcaccgcgcgcgcatcgaaagggccaccgcgtttgaccgtatgaatatgcaataa

SEQ ID NO: 394 - DNA, 2814 bp, Adenovirus B7; identical to SEQ ID NO: 193
  MISC_FEATURE (1)..(2814): B7.orf00036 L3 hexon protein

SEQ ID NO: 395 - DNA, 138 bp, Adenovirus B7
  MISC_FEATURE (1)..(138): B7.orf00037 L3 hexon
atgtgcatgtatgcccattggggcatcatcgatggggtggccatcttgaaagcaactcagcctcggcgcgcgacctcttcctttctcctctgctgcggcggcgtggtgatgatacatacacacagacaagcaagttaa

SEQ ID NO: 396 - DNA, 753 bp, Adenovirus B7
  MISC_FEATURE (1)..(753): B7.orf00038 L3 protein pVI
atggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatctggccaaccaggctgtacaaaaacagataaacagccgactggacccgccgcccgcaacccctggtgaaatggaagtggaggaagagcttcctccgctggaaaagcggggcgacaagcgtccgcgacccgagctggagcagacgctggtgacgcgcgcagacgagcccccttcatacgaggaggcagtaaagctaggaatgcccactactaggcccgtagctcacatggctaccggggtgatgaaaccttctcagtcacatcgacccgccaccttggacttgcctcctccccctgcttctgcggcgcttgttcccaaacctgtcgctaccagaaagcccaccgccgtacagcccgtcgccgtagccagaccgcgtcctgggggcacaccgcgcccgaaagcaaactggcaaagtactctgaacagcatcgtgggtctgggcgtgcagagtgtaaagcgccgtcgctgctattaa

SEQ ID NO: 397 - DNA, 228 bp, Adenovirus B7
  MISC_FEATURE (1)..(228): B7.orf00039 L2 protein pX
atggccctcacttgccgccttcgcgtccccattactggctaccgaggaagaaactcgcgccgtagaaggatgttggggcgagggatgcgccgccacagacgaaggcgcgctatcagcagacgattagatggtggctttttgccagctcttatacccatcatcgccgcagcgatcggggcgataccaggcatagcttccgtggcggttcaggcctcgcagcgccactaa

SEQ ID NO: 398 - DNA, 1053 bp, Adenovirus B7
  MISC_FEATURE (1)..(1053): B7.orf00041 L2 protein pV
atgtccaagcgcaaatacaaggaagagatgctccaggtcatcgcgcctgaaatctacggtccaccggtgaaggatgaaaaaaagccccgcaaaatcaagcgggtcaaaaataacaaaaaggaagaagatgacgctgatgggctggtggagtttgtgcgcgagttcgccccaagacggcgcgtgcagtggcgcgggcgcaaagtgcgtcaagtgctcagacccgggaccactgtggtctttacacctggcgagcgttccagcactacttttaaacggtcctatgatgaggtgtacggggatgacgatattcttgagcaggcggcagaccgccttgacgagtttgcttatggcaagcgcactagatccagtcccaaagaggaggcggtgtccattcccttggatcatggaaatcccacccccagcctcaaaccagtcaccctgcagcaagtgctgcccgtgcctgcgcggagaggcgtaaagcgcgagggtgaggacctatatcccaccatgcagctaatggtgcccaagcgccagaggctagaagacgtactggagaaaatgaaagtggatgccgatatccagcctgaggttaaagtaagacctattaaggaagtggcgccaggtttgggagtacaaaccttcgacatcaagattcccaccgagtccatggaagtgcagaccgaacctgcaaaacccacaaccacctcaattgaggtgcaaacggaaccctggatgcccgcgcccgttgccgcccccagcaccactcgaagatcacgacgaaagtacggcccagcaagtctgctaatgcccaactatgctctgcacccatccatcattcccactccgggttacagaggcactcgctactatcgaaaccggagcaacacctctcgccgccgcaaaccacctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaa

SEQ ID NO: 399 - DNA, 579 bp, Adenovirus B7
  MISC_FEATURE (1)..(579): B7.orf00042 L2 major core protein  pVII
atgtccattctcatctcgcccagtaataataccggttggggactgtatgcgcccaccaagatgtatggaggcgcccgcatacgctctacccagcaccctgtgcgcgttcgcggtcatttccgcgctccatggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcattgctaggcgccacagggctactaccgccatgcgagctgcaaaagctattctgcggagggccaaacgtgtggggcgaagagccatgcttagagcggccagacgcgcggcttcaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcacccgcccccctcgcacttag

SEQ ID NO: 400 - DNA, 1563 bp, Adenovirus B7; identical to SEQ ID NO: 165
  MISC_FEATURE (1)..(1563): B7.orf00043 L2 penton protein

SEQ ID NO: 401 - DNA, 1767 bp, Adenovirus B7
  MISC_FEATURE (1)..(1767): B7.orf00044 L1 hprotein IIIa
atggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttcggccatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcaaaccaacctggaccggatggtgaccgatgtgcgcgaggccgtgtctcagcgcgagcggttccagcgcgacgccaacttggggtcgttggtagcgctaaacgcttttctcagcacccagcccgccaacgtgccccgtggtcagcaagactatacaaactttttgagtgcattgagactcatggtagctgaggtgccccagagcgaggtgtaccagtccgggccagattacttcttccagaccagcagacagggcttgcagacagtgaacctgactcaggctttcaaaaacctgaagggtctctggggagtgcacgccccagtaggggatcgcgcgaccgtgtctagcttgctgactcccaactcccgcctgctgctgctgctggtatccccctttactgacagcggtagcatcgaccgcaactcctacttgggctacctgcttaacctgtatcgcgaggccataggacagagccaggtggacgaacagacctatcaagaaatcacccaagtgagccgcgccctgggtcaggaagacacgggcagtttggaagccaccctgaacttcttgttaaccaaccggtcgcagaagatccctcctcagtatgcgcttaccgctgaggaggagcggatccttagatacgtgcaacagagcgttggattgttcctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtagacagcagcatattctccccgcctcccggttatacagtttggaagaaggaagggggcgatacaaggcactcttccgtgtcgctgtccagaacggctggtgctgccgcgaccgtgcccgaagctgcaagtcctttccctagcttgcccttttcactaaacagcgttcgcagcagtgaacttgggagaataacccgcccgcgcttgatgggcgaggatgagtacttgaatgactctttgttgaggccagagagggaaaagaacttccccaacaatggaatagagagcctggtggataagatgagtagatggaagacctatgcgcaggatcacagagacgagcccaaaatcttgggggctacaagcagaccgacccgtagacgccagcgccacgacaggcagatgggtcttgtgtgggacgatgaggactctgccgatgatagcagcgtgttggacttgggtggaagaggagggggcaacccgttcgctcatctgcgtcccagattcgggcgcatgttgtaa

SEQ ID NO: 402 - DNA, 1158 bp, Adenovirus B7
  MISC_FEATURE (1)..(1158): B7.orf00045 L1 52/55-kDa protein
atgcatccagtgctgcgacagatgcgcccccagcaacaggccccttctcagcaacagccacaaaaggctcttcttgctcctgcaactactgcagctgcagccgtgagcggcgcgggacagcccgcctatgatctggacttggaagagggcgagggattggcgcgcctgggggctccatcgcccgagcggcacccgcgggtgcaactaaaaaaggactctcgcgaggcatacgtgccccagcagaacctgtttagggacaggagcggcgaggagccagaggagatgcgagcatctcgatttaacgcgggtcgcgagctgcgccacggtctggatcgaagacgggtgctgcaagacgaggattttgaggtcgatgaagtcacagggatcagcccagctagggcacatgtggccgcggccaacctagtctcggcctacgagcagaccgtgaaggaggagcgcaacttccaaaaatcttttaacaaccatgtgcgcaccctgattgcccgcgaggaagtgaccctgggtctgatgcatctgtgggacctgatggaggctatcgcccaaaaccccactagcaaaccactgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtgaagatagatgggttttacatgcgcatgactctaaaggtactaactctaagcgacgatctgggggtgtatcgcaatgacaggatgcatcgcgcggtgagcgccagtaggaggcgcgagctgagcgacagagaacttatgcacagcttgcaaagagctctaacgggggccgggactgatggggagaactactttgacatgggagcggacttgcaatggcaacccagtcgcagggccatggaggctgcagggtgtgagcttccttacatagaagaggtggatgaagtcgaggacgaggagggcgagtacttggaagactga

SEQ ID NO: 403 - DNA, 1923 bp, Adenovirus B7
  MISC_FEATURE (1)..(1923): B7.orf00047 E2B pTP
atgaactacttcatgccgctgcgcaacatctggaaccgcgtgcgcgagttcccacgtgcatccaccaccgcctccggtatcacctggatgtccaggtacatctacggctaccaccgcctcatgctggaagacctcgcccccggagccccggctacagagcgatggcccctgtaccgccagccatcgccacactttctcatcggctaccagtacctggtgcgcacctgcaacgattacatctttgacacgcgcgcatactcgcgcctgaagtacaccgagctcgtgcgccctgggcaccagacagtcaactggtcagtcatggccaactgctcctacacaatcaacaccggggcctaccaccgcttcgtggactttgacgactttcaagccaccctcacccaggtgcagcaagccatcctcgccgaaagggttgtagcggatctggcacttgtccagcccatgcgcgggttcgggatcactcgcatgcatggcagggcgggcgaagaagaagtgcccgtggaacgactcatgcaagactactataaagatctggccagatgtcaggataatgcttggggaatggctcatcgcctgcgcatccaacaagccggacccaaagacctggtgctcctcgccaccatccgccgtcttaaaactgcctattttaatttcatcaccagcagcatcgtctcaccctcgcaagaggaggaaggagaagaaagagagaaccccgaccgagcgtctagccgcccccgcccgcaagaaacagtgctcagcctaccttgcgattgcgactggttagacgctttcgtcgaaaggttttcagatcccgtggatcttgagacaatcaggtccttgcgcggagtacctacggggcaattgataaaatgcataatcagcgcggtgtccctgcccaacggagagcctcccagtcaccacttcagggagatgcgcggaggcgtcttcactctgagacccagggagaacggtcgtgccgtcaccgagactatgcgccgccgccgcggagaggtcattgaaagattcatcgaccgtctgcccgtgcgccgccggcgtcgccgcgttccccctcctcctgcagccccacctgaagaggaagagatgttagtggaagaagaagagattgaggaagaaatcctaggagctttcgagcgcgaggtgcgcaccaccatcgccgaacttatccgtcttctggaagaggagttgaccgtgtccgcgcgtaactcccagtttttcaactttgccgtggacttctacgaggccatggagcgcttggaagcgctgggcgatgtcagcgagatgccgctgagacgatggatcatgtatttcttcgtcaccgagcacatcgccaccacactcaactaccttttccagcgcctatgcaactatgcggtcttcacccgccacgtggagctcaacctcgcccaggtggtcatgcgcgcgagagatcccgtgggggctgtggtctacagccgcgtctggaacgaggcgggcatgaatgctttctctcaactcattgggcgcatctccaacgacctcgcggccaccgtcgagagagcgggccgcggagatcttcaagaggaagagatcgagcagttcatggccgagatcgcctaccaggacaactctggcgacgtgcaagaaatccttaggcaagccgccgtcaacgataccgagattgattctgttgaactctctttcaggttcaagctcacggggccggtagctttcacccagaggcgtcagatccaggatgtcaaccgccgcgtcgtcgcgcatgcgagtcttctcagggcgcagtaccagaacctacccgcgcgcggtgccgacgtaccactgccagccatgccgccgggtcccgagccgcccctgccgcccggtgcgcgccctcgacaccgcttctaa

SEQ ID NO: 404 - DNA, 3369 bp, Adenovirus B7
  MISC_FEATURE (1)..(3369): B7.orf00048 E2B DNA polymerase
atgcaagaagcaacagagccaccgccgcccaaaaggaaaaacaagggcacggtggtagcgcccaaggggcacggaaccctgcaagccatcgacatctccaccaacggacccgtggagatcaagtaccatctgaacctccctcacgccctcgaaaagatcatgcaagtcaatctcctgacactgcctactaacctgactccgcagcgtctcaggaccctggacagctccggcctgcgcgctctcgtcctcgagctccgcccctgccgcgccgaggtctggacttgcctcccgcgagggctcgtcagcatgaccaccatcgagacagaagatggtcatgccgatgcagacaacatagtagagcgcgaggtacaagcgccaggcctcaattttccactgaaatttctcgtcaaaggaagtcaggtacaactcattcatgaggtgcatcccgtgaatcgctgcgagtactgcggccgtctgtacaagcacaagcatgaatgctcggcgcgtcgcagggagttctacttccatcacatcaacagccattcctccaactggtggcaggaaatccagttcttcccgattggctctcatcctcgcacagaaaggctcttcctcacctacgatgtggaaacctacacctggatggggtcctttggcaagcagctaatccccttcatgctggtcatgaaactctctggagaccagcggctcgttaacatcgcctatgacatcgccatgaaactcaagtgggatcgctggcggcaggacccccaaaccttctattgcatcaccccagaaaagatggcagtcggacagcattttcgtcagtaccgggaccagttacaaacagcactggcagtggacctctggtcctccttcctcaaagcgaaccctcacatgcacgaatgggccctcgaacactatgctctcactgaccctacagatctcacttttgaagaactcaagaagctgcctcatgtcaggggcacccctcgattcttagaactgtacatagtggggcacaacatcaatggctttgatgagatcgtcttggccgctcaggttatcaataaccgagcagaggtccctcagccttttaaaatcacccgaaatttcatgcccagggccggcaagatcctcttcaatgatgttactttcgctttgcccaatcccgcctacaagaagcgggcggacttccaactctgggaacagggggcctgtgatgacatcgacttcaagtatcaattcctcaaagtcatggtcagggacacttttgccctcactcatacctcgctgcgcaatgcagcccaagcatactctctcccagtggagaagggatgctgtccctacaaggcagtcaatcagttctacatgttgggctcttaccgtgcagaaaaagacgggtttcccctcgaagagtactggaaggatcacgaagaataccttctcaaccgcgagctgtgggaaaagaaaagccaaccgcgttatgacatcatccaggaaactctcaactactgtgccctggatgtactcgtcaccgcagagctggtagccaagctgcaagagtcatatgcccacttcataagagactctgtaggcctacctcatgcccattttaacatattccagagacctactatttcttccaattcccatgccatctttcgccaaatcgtttacagggcggaaaaacccaaccgcaccaatctgggcccgggtcttctcgccccctcacatgaactctatgactatgtgcgagcaagcatcagaggggggcgctgttatcccacttacatcggcatcctcgaagagcccctctatgtctacgatatctgtggcatgtatgcctccgcgctcacccaccccatgccctggggcacccctcttaacccctatgagcgcgcgctggcagttcgagaatggcagatgaccttggatgatcctgccaccatcagctattttgacaaagatttgctaccgggaatatttaccatagatgcggacccccctgatgagttcatgctagaccccctcccccctttctgttcaagaaaaggaggtcgactctgctggaccaatgagcccctccgaggcgaggtggccaccagtgtggatctgataaccctgcacaataggggatggcgagtcagaatagttccggatgaactgacaaccatctttcctgaatggaaatgtgtggcgcgcgagtacgtccagcttaacatcgccgccaaggagcgcgcggacaaggaaaagaaccaaaccatgcgctccatcgccaagcttctatccaatgccctctatggatcatttgccaccaagctggacaacaagaagattgtgttttctgaccagatggacgagagtcttataaaaggcatctctgctggtactgtcaatatcaaatcctcctcgttcctagaaactgacaacctgagtgcagaggtcatgcccgcattcgagagggaatacctaccccaacagctggcgctcctggacagcgatccggaagacagtgaggacgaacagaggtccgcccccttttatacccccccggcggggacccctggtcacgtggcctacacttacaagccaatcacattcttggatgtggaggagggggacatgtgtttacataccgtagagaaggtggatcccctggttgacaacgaccgctacccctcccacgtggcctcctttgtgctggcctggacacgcgcttttgtatcagagtgggctggattcctctacgaagaggaccgaggcactccgctcgaggacaggcccataaagtcggtctacggggacacggacagcctctttgtcacccagcgtggacacgaactcatggaaaccaaaggtaagaaacgcatcaaaaaacatggcggaaaacttgtttttgaccctgatgagccggatctgacctggcttgtggagtgcgaaaccgtctgcgtctcctgcggtgcggatgcatactcccccgaatccattttcctcgcgcccaagctgtatgccctcaaatgtatctactgccctgcctgccataaaacttccaaaggtaagctccgtgccaaaggccacgcggccgaggcgctcaactacgaacttatggtaaactgctacctggccgacatgcagggcgccgatcggcagcggttctcgaccagcaggatgagtctgaagcgcaccctcgcaagcgcccaaccaggcgcgcaccccttcaccgtgacggaaacaaccctgactcggacgctgcgaccatggaaggatcggaccctggcagcgctggacgcccatcgtctgattccctactccaggagccgtcccaacccgcgaaacgaggaggtctgctggatcgagatgccatag

SEQ ID NO: 405 - DNA, 1047 bp, Adenovirus B7
  MISC_FEATURE (1)..(1047): B7.orf00049 IVa2 protein IVa2
atgcccatggctgacgggctgaagccgctgaaaaacttctcctcgctccaggagcttctatcacttgggggagagcgcctcctaacggacttggtgcgggaaaatatccatgtaagggaaatgatgaacgaagtggcccccctgctccgggaggacggcagctgtcgctccctaaactaccatctgcaacccgtaattggggtcatttacggtcccaccgggtgcggcaagtctcagctgcttaggaatttgctctcatcccagttaatcaccccggctccagaaacggtattttttatagccccgcaggtggacatgatccccccctctgaactgaaagcctgggaaatgcaaatatgtgagggaaactatgctcccgggccacagggaactttcatcccccaatctggcaccctccgcccaaagtttattaaaatggcttatgatgacctgactcaggagcataactatgatgtttcagacccccggaacgtgttcgcccgtgccgctgcccacggccccatcgctatcattatggatgagtgcatggagaatctggggggtcacaaaggcgtctccaaattttttcatgcttttccctctaagctgcatgataaatttcccaagtgcaccggatacactgtcttggtggtcctgcacaatatgaacccgagacgggatctaggcggcaacattgccaacctcaagatccagtccaaaatgcatataatttcaccccggatgcacccgtcccagctcaacagatttgtaaacacctacactaagggcctccccgttgcaattagtctgctcctaaaagatattgtgcaacaccatgcactccgaccttgctatgactgggtgatttataacactaccccggagcaagaggctcttcaatggagctatctccacccccgagacggactaatgcccatgtatctaaacattcaatcccacctttacagggtactggaaaagatccaccgagttctcaatgatcgaaaccgatggtccagggcataccgcgcgcgaaaaatcaaataa

SEQ ID NO: 406 - DNA, 417 bp, Adenovirus B7
  MISC_FEATURE (1)..(417): B7.orf00052 IX hexon-associated protein IX
atgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattacggaagcattgttgccaattccagttcctctaataatccttcaaccctggctgaggacaagctacttgttctcttggctcagctcgaggccttaacccaacgcttaggcgaactgtctaagcaggtggcccagttgcgtgagcaaactgagtctgctgttgccacagcaaagtctaaataa

SEQ ID NO: 407 - DNA, 1122 bp, Adenovirus B7
  MISC_FEATURE (1)..(1122): B7.orf00054 E1B transformation-associated 55 kDa protein
atgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagcttttagatgttgtatgatgggtatgtggccaggggttgtcggcatggaagcaataacacttatgaatattaggtttagaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtgaagagtcagttgtctgtgaagaaatgcatgtttgagagatgtaatcttggcatactgaatgaaggtgaagcaagggtccgccactgcgcagctacagaaactgcctgcttcattctaataaagggaaatgccagtgtgaagcataatatgatctgtggacattcggatgagaggccttatcagatgctaacctgcgctggtggacattgcaatattcttgctaccgtgcatatcgtttcacatgcacgcaagaaatggcctgtatttgaacataatgtgattaccaagtgcaccatgcatataggtggtcgcaggggaatgtttatgccttaccagtgtaacatgaatcatgtgaaggtaatgttggaaccagatgccttttccagagtgagcgtaacaggaatctttgatatgaatattcaactatggaagatcctgagatatgatgacactaaaccaagggtgcgcgcatgcgaatgcggaggcaagcatgctagattccagccggtgtgcgtggatgtgactgaagacctgaggcccgatcatttggtgcttgcctgcactggagcggagttcggttctagtggtgaagaaactgactaa

SEQ ID NO: 408 - DNA, 537 bp, Adenovirus B7
  MISC_FEATURE (1)..(537): B7.orf00055 E1B 21-kDa
atggaggtttgggctatcttggaagacctcagacagactaggctactactagaaaacgcctcggacggagtctctggcctttggagattctggttcggtggtgatctagctaggctagtgtttaggataaaacaggactacagggaagaatttgaaaagttattggacgacattccaggactttttgaagctcttaacttgggccatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctgggagtagcagggatactgagacacccaccgaccatgccagcggttctgcaggaggagcagcaggaggacaatccgagagccggcctggaccctccggtggaggagtag

SEQ ID NO: 409 - DNA, 201 bp, Adenovirus B7
  MISC_FEATURE (1)..(201): B7.orf00056 E1A mRNAII protein
gtgtctgatgatgagtcaccttctcctgattcaactacctcacctcctgaaattcaggcgcccgcacctgcaaacgtatgcaagcccattcctgtaaagcctaagcctgggaaacgccctgctgtggataagcttgaggacttgttggagggtggggatggacctttggaccttagtacccggaaactgccaaggcaatga

SEQ ID NO: 410 - DNA, 594 bp, Artificial Sequence
  B7.orf00058 E1A hypothetical protein
atgagacacctgcgcttcctgccacaggagattatctccagtgagaccgggatcgaaatactggagtttgtggtaaataccctaatgggagacgacccggaaccgccagtgcagccttttgatccacctacgctgcacgatctgtatgatttagaggtagacgggccggaggatcccaatgagggagctgtgaatgggttttttactgattctatgctgctagctgccgatgaaggattggacataaaccctcctcctgagacccttgtcaccccaggggtggttgtggaaagcggcagaggtgggaaaaaattgcctgatctgggagcagctgaaatggacttgcgttgttatgaagagggttttcctccgagtgatgatgaagatggggaaactgagcagtccatccataccgcagtgaatgagggagtaaaagctgccagcgatgtttttaagttggactgtccggagctgcctggacatggctgtaagtcttgtgaatttcacaggaataacactgggatgaaagaactattgtgctcgctttgctatatgagaatgcactgccactttatttacagtaagtgtatttaa

SEQ ID NO: 411 - DNA, 378 bp, Adenovirus B16
  MISC_FEATURE (1)..(378): B16.orf00002 E4 13.9 kDa protein
atggctgatgaggctttgtatgtgtatttagagggaccgggggcgacgttgcctgaacagcagcagagaaataattatattttttattctcctgtgccttttactttgtatccgcgaggggtggctttgctatacttaagattaagcataattatacccagaggctatgttggctgttttttctctttaactgatgctaacatgtctggattatatgcttcatcaagaattattcatgctggccaccgcgaggaactttcggtgctgttgtttaatcacgatgacaggttttacgagggtcaagctggagaccctgtggcttgtcttgtgatggaaagactgatttatccacctgttcgacaggctactatgatatga

SEQ ID NO: 412 - DNA, 435 bp, Adenovirus B16
  MISC_FEATURE (1)..(435): B16.orf00003 E4 ORF2 protein
atgacgcttgtttcttttattttacagactaattcaaaactaacaatgttggagcgcagcgcggtaacctattgcatttgcatcccagaggttttgaatgtttctttggaaaatttttcttttattcaatttttacaagaaactctgcctgattatatttccagcaactttgatgatattactggtggttcccagtatgcttattctaatcttgtttttgctggagccaattggggaggtctgcgcttgtactgcactgtagcgtcccctgctattgttcccggggggcttctggctaagcagtttggtgataatatgagagagtatttacaactagaacttagagaagaacttagagccaagggcatgtcaattgatgatgccattcttaatttgctacaggtgacacaggagcaagatattttgtcattatga

SEQ ID NO: 413 - DNA, 354 bp, Adenovirus B16
  MISC_FEATURE (1)..(354): B16.orf00004 E4 ORF3 protein
atgagggtgtgtttaagaatggtggtggagggcgccctccgggacctgtttgtaatgtgtggtttggatttaccacaagaactgacacgaataattcaaggctggaaagctgaaaattatctgggaatggtgcaggaatgtaatatgatgtttgaggagttagaaaatgctccttcttttggtattcttttgtttttggatgtgcgcgtggaggctttgttggaagccaccgttgagcaccttgaaaatcgcatttcttttgatttagctgtgctttttcaccaacacagtgggggcgatagatgccatctgcgcgatctacaatttgaagtactgcgagatcgtttggaataa

SEQ ID NO: 414 - DNA, 897 bp, Adenovirus B16
  MISC_FEATURE (1)..(897): B16.orf00010 E4 34 kDa protein
atgtcaggaagcaactccattatgacaaggttgcgcgcacgctcgacatcatgcgccagacatcacccttacaccagagcccagttaccacgatgtgaggaaaatgaaacccgagcttctatgactgaagaccacccgctgttgccagattgtgatactatgactatgcatagtgtaagttgtgttcgtggtcttccttgttctgccagctttactgttttgcaagagcttcctattccctgggatatgtttttaacccccgaagagttgagggttatgaaaagatgcatgcatttatgtttgtgttgtgccactatagatatatttaattctcaagtgatccatgggcgagagaagtgggttctccattgtcactgtaaacagccgggttctcttcaatgtattgctgggggagcagtgctagctatgtggttccggaaggttattaggggctgtatgattaaccagcgctgtccatggtacagagaaattgtgaacatgcatatgcccaaggaaattatgtatgtgggcagtgtgttctggagggggcgtcatctaatttacattaagatttggtacgatggtcacgcgggtatgattatccctgagatgagttttggctggagcacctttaattatggcctgttaaacaacattgtggtaatgtgttgtacctactgcagtgagctaagcgaaattagaatgcgttgttgtgcccatcgcaccaggatgttaatgttgagggctattaaaattatgcttcgagagactgtggatcctgatcccatcagcagcagtcgcacggagcggcgcagacagcgattgcttcgaggtttaagacacaaccgcccgatcccgttctcggattatgactcccatcgttcttcttccagatga

SEQ ID NO: 415 - DNA, 252 bp, Adenovirus B16
  MISC_FEATURE (1)..(252): B16.orf00011 E4 ORF6/7 protein
atgaccctaatccaaaccccggagccgcagccgcagcagttggactgtgaaaccaccttgaaagactgttccgatggatttatatctatcactgatccaagattggcccgctctgaaactgtgtggaatgtggaatctaaaactatgtctatctctaatggaattcaaatgttcaaagctgtgcgtggggagagaattgtgtattctataaaatgggaagaggggggcaaaataactactcgaatcttgtaa

SEQ ID NO: 416 - DNA, 1062 bp, Adenovirus B16; identical to SEQ ID NO: 134
  MISC_FEATURE (1)..(1062): B16.orf00013 L5 fiber protein

SEQ ID NO: 417 - DNA, 165 bp, Adenovirus B16
  MISC_FEATURE (1)..(165): B16.orf00014 U protein
atgaagattgtgggcaaagaagaggaactaaaatttgacatccctttcaaagtgtggaggaagtatgccacccgccgaggcttagagtaccagagttgggaagaaggaagtgaggtgctgcttggaaacaacgtagacagaaaccttatttctgatttcaagtaa

SEQ ID NO: 418 - DNA, 408 bp, Adenovirus B16
  MISC_FEATURE (1)..(408): B16.orf00016 E3 14.7 kDa protein
atgactgaaatactcaccacctccaattccgccgaggatctgcttgatatggacggccgcgcctcagaacagcgactcgcccaactacgcatacgccagcagcaggaacgtgccgccaaggagctcagggatgctattgaaattcaccaatgcaaaaaaggcatattttgtttggtaaaacaagccaagatatcctacgagattaccaatactgaccatcgcctctcatacgagctcggaccgcagcgacaaaaattcacttgtatggtgggaatcaaccccataatcatcacccagcaagctggagataccaagggttgcatccactgttcctgcagttccgccgagtgcatctacaccctgctgaagaccctctgcggccttcgagacctcctacccatgaactaa

SEQ ID NO: 419 - DNA, 405 bp, Adenovirus B16
  MISC_FEATURE (1)..(405): B16.orf00017 E3 14.9 kDa protein
atgcaggctatgctgccagtcattttaattctgctcctaccctgcattgccctagcttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagaaccacatgaacatatcccactacaacacatacaacaaccactagcactggtagagtatgaaaatgagccacaaccttcactgcctcctgccattagttacttcaacctaaccggcggagatgactga

SEQ ID NO: 420 - DNA, 276 bp, Adenovirus B16
  MISC_FEATURE (1)..(276): B16.orf00019 E3 10.3 kDa protein
atgattcctagaaatttcttcttcaccatactcatctgtgctttcaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtgcgaattgcctacctacgtcaccatcccgaataccgcaatcaaaatgttgcggcactttttaggcttatttaa

SEQ ID NO: 421 - DNA, 285 bp, Adenovirus B16
  MISC_FEATURE (1)..(285): B16.orf00021 E3 11 kDa protein
atgatattgtttcaatcaaataccactaacactatcaatgtgcagactactttaaatcatgacatggaaaaccacactacctcctatgcatacacaaacattcagcctaaatacgctatgcaactagaaatcaccatactaattgtaattggaattcttatactatctgttattctttattttatattctgccgtcaaatacccaatgttcatagaaattctaaaagacgacccatctattctcctatgattagtcgtccccatatggctctgaatgaaatctaa

SEQ ID NO: 422 - DNA, 570 bp, Adenovirus B16
  MISC_FEATURE (1)..(570): B16.orf00023 E3 20.5 kDa glycoprotein
atgatttccactacaatttttatcattactagccttgcagctgtaacttatggccgttcacacctaactgtacctgttggctcaacatgtacactacaaggaccccaagaaggccatgtcacttggtggagaatatatgataatggagggttcgctagaccatgtgatcagcctggtacaaaattttcatgcaacggaagagacttgaccattattaacataacattaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttcgaaaaatcgctttaagtaattccacagccgctcccaatacaattcctaaatcaacaattggcatcattactgccgtggtagtgggattaataattatatttttgtgcataatgtactacgcctgctgctatagaaaacatgaacaaaaaggtgatgcattactaaattttgatatttaa

SEQ ID NO: 423 - DNA, 540 bp, Adenovirus B16
  MISC_FEATURE (1)..(540): B16.orf00024 E3 20.1 kDa protein
atggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactaaaccaatatttgtaatctgcaacagacaaaatctcacgttaattaatgtcagcaaaatttataacggttactattatggttatgatagatccagtagtcaatataaaaattacttagttcgcataactcaacccaaatcaacagtgccaactatgacaataattaaaatggctaataaagcattagaaaattttacattaccaacaacgcccaatgaaaaaaacattccaaattcaatgattgcaattattgcggcggtggcattgggaatggcactaataataatatgcatgttcctatatgcttgttgctataaaaagtttaaacataaacaggatccactactaaattttaacatttaa

SEQ ID NO: 424 - DNA, 519 bp, Adenovirus B16
  MISC_FEATURE (1)..(519): B16.orf00025 E3 19.2 kDa protein
atgggggccatactagtcgtgcttgctttactttcgcttttgggtctgggctctgctaatctcaatcctcttgatcacgatccatgtctagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttcccgagtggtatactgtctctgtccgaggtcctgacggttccattcgcattagtaacaacactttcattttttctgaaatgtgcgatctggccatgtttatgagcaaacagtatgacctatggcctcctagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaa

SEQ ID NO: 425 - DNA, 321 bp, Adenovirus B16
  MISC_FEATURE (1)..(321): B16.orf00028 E3 11.7 kDa protein
atgtctaatggtggcgcggctgagctagctcgactgcgacacctagaccactgccgccgctttcgctgtttcgcccgggaactcaccgagttcatctacttcgaactctccgaggagcaccctcagggtccggcccacggagtgcggattaccatcgaagggggaatagactctcgcctgcatcgcatcttctcccagcggcccgtgctgattgagcgcgaccagggaaatacaaccatctccatctactgcatttgtaaccaccccggattgcatgaaagcctttgctgtcttgtttgtgctgagtttaataaaaactga

SEQ ID NO: 426 - DNA, 684 bp, Adenovirus B16
  MISC_FEATURE (1)..(684): B16.orf00029 L4 protein VIII
atgagtaaagagattcccacgccttacatgtggagctatcagccccaaatggggttggcagcaggtgcttcccaggactactccacccgcatgaattggcttagcgccgggccctcaatgatatcacgggttaatgatatacgagcttatcgaaaccagttactcctagaacagtcagctctcaccaccacaccccgccaacaccttaatccccgaaattggcccgccgccctggtgtaccaggaaaatcccgctcccaccaccgtactacttcctcgagacgcccaggccgaagttcagatgactaacgcaggtgtacagctggcgggcggttccgccctatgtcgtcaccgacctcaacagagtataaaacgcctggtgatcagaggccgaggtatccagctcaacgacgagtcggttagctcttcgcttggtctgcgaccagacggagtcttccagatcgccggctgtgggagatcttccttcactcctcgtcaggctgtgctgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattga

SEQ ID NO: 427 - DNA, 297 bp, Adenovirus B16
  MISC_FEATURE (1)..(297): B16.orf00030 L4 33 kDa protein
gtgaccagaaaaccagcagttagaaaatccacaacaagtgcagcaggaggaggactgaggatcacagcgaacgagccagcgcagaccagagagctgaggaaccggatctttccaaccctctatgccatcttccagcagagtcgggggcaagagcaggaattaaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtag

SEQ ID NO: 428 - DNA, 129 bp, Adenovirus B16
  MISC_FEATURE (1)..(129): B16.orf00031 L4 22 kDa protein
gtgaacttcccccgcaatatcttgcattactaccgtcacctccacagcccctactgcagtcagcaagtcccggcaaccccgacagaaaaagacagcagcgacaacggtgaccagaaaaccagcagttag

SEQ ID NO: 429 - DNA, 2487 bp, Adenovirus B16
  MISC_FEATURE (1)..(2487): B16.orf00032 L4 100 kDa hexon-assembly associated protein
atggaaactcagccatcactgccaacatcgctgcaagcgccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaagcagatggcgatcaccaggaggctggcctcggggatcatgttgccgactacctctccgggcgtgggggggaggacgtgctcctcaaacatctagcaaggcagtcgctcatagttaaagacgcactactcaacctcaccgaagtgcccatcagtgtggaagagcttagccgcgcctacgagctgaacctcttttcgcctcagataccccccaagcggcagccaaacggcacctgcgaggccaaccctcgactcaacttctatccagcttttactgtccccgaagtgctggccacctaccacatcttttttaagaaccaaaagattccagtctcctgccgcgccaaccgcacccgcgcagatgcccttctcaacttgggtccgggagctcgcttacctgatatagcttccttggaagaggttccaaagatctttgagggtctgggaagtgatgagactcgggccgcaaatgctctgcaacagggagagaatggcatggatgaacatcacagcgctctagtggaactggagggtgacaatgcccggcttgcagtgctcaagcgcagtatcgtggtcacccattttgcctaccccgctgttaacctgccgcccaaagtcatgagcgctgtcatggaccatctgctcatcaaacgagcaagtccactttcagaaaaccagaacatgcaggatccagacgcctcggacgagggcaagccggtagtcagtgacgagcagctatctcgctggctgggtaccaactccccccgagatttggaagaaagacgcaagcttatgatggctgtagtgctagtaactgttgagttggagtgtctgcgccgcttttttaccgaccccgagaccctgcgcaagctagaggagaacctgcactacaccttcagacatggcttcgtgcggcaggcatgcaagatctccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaaccttaaagagctggacaagctcttgcagagatccctcaaagccctgtggacaggttttgacgagcgcaccgtcgcctcggacttggcggacatcatcttccccgagcgtcttagggttactctgcgaaacggcctgccagacttcatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctattccgcctggccaactacctctcctaccactcggatgtgatagaggatgtgagcggagacggcctgctggaatgccactgccgatgcaatttatgcacaccccaccgctccctcgcctgcaacccccagttgctaagcgagacccagatcatcggcaccttcgagttgcagggtcccaacagtgaaggcgaggggtcttctccggggcagagtctgaaactgacaccggggctgtggacctccgcctacctgcgcaagtttcatcccgaggactatcatccctatgagatcaggttctatgaggaccagtcacatcctcccaaagtcgagctctcagcctgcgtcatcacccagggggcaattctggcccaattgcaagccatccaaaaatcccgccaagaatttctgctgaaaaagggaagcggggtctaccttgacccccagaccggtgaggagctcaacacaaggttcccccaggatgtcccatcgccgaggaagcaagaagctgaaggtgcagctgtcacccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtag

SEQ ID NO: 430 - DNA, 1554 bp, Adenovirus B16
  MISC_FEATURE (1)..(1554): B16.orf00034 E2A DNA binding protein
atggccagccgcggaggaaatcagtcaagcgaccgccaacgggagcacacccccgaacgcggaatgggctctgccagccatccgcctccaaggccagaccgcagcccatctcagtcgcctccacctctgcccccgaagaggaacacctaccgtcgcgtggggtccgattcttctatcgagagccaggtggtactggtaagcgaaacttcgcggtcatccctgtctccggaacggagcaacagtcctcccccgatccctcccaagaagaagcccaggaagaccaagcatgtccctctgcaagacatcagccaggacagcgaagaagaaagagaacaggctcagttggtggccgtgggcttcagctaccccccggtgcgcatcattgagaaggatggcaagagaagtgttgagaagatcgacaagaatgaccctatagctaaaggagctacttctattgctgttaggaatcctttgagcttgcccctggtatctgcctgggagaagggcatggaagtgatggctgtgctaatggagaggtataggctggataatgacctgagaacctctttcaagctgatgccagagcagcacgagcagtacaagcgtatctgccaccagtatgtgaacgaggagcaccgtggcattccgctgacatttagtagcatgaagaccctgacagcgatgatgggaagattcatgcagggattggtgcattcttattctgagatcgcccacaataattgggagtgcaccgggtgcgctctgtgggctcatggatgcaccgattacgaaggcaaggtgaaatgcctgcatggcactatcatgatccagaaggaccacattatcgagatggatgtggcgagcgagaacgggcagcgcgctatgaaggagaacccagacagagccaagatcacccagaaccgctggggcagaaatgtggttcagttggccaacaacgatgcccgctgctgtgtaaatgatgccaactgtgctactaaccaattttccagcaagtcctgtggaatgttctacaccgagggaagtaaggctcaggaagctttcaagcagtacgaagccttcatgaaggccgtatatccagggataacccccgaccaagccaggatgatgctgattcccattcattgcgattgcaaccacaagccaggctgcgctcccgtgatgggcaggcagacctgtaagatgaccccctttgggatggccaatgctgaagacttggatgtgactaccatcagtgacccgaccgtgctggcaagcgtgagacacccagccttgatggtgttccagtgttgcaacccagtgtaccgcaactcccgtgtccagaatgccggccccaactgtgatttcaagatctctgctcctgacctgcttggcgccctgcaactgaccagaaagttgtggcaagacacctttcccgagattccagttcccaagctggtgatccccgagttcaagtggcagaacaggttacagttccgcaacgtatccctgcccgcgggccactatgactcccgccagaacccatttgatttctga

SEQ ID NO: 431 - DNA, 630 bp, Adenovirus B16
  MISC_FEATURE (1)..(630): B16.orf00036 L3 23 kDa proteinase
atgtcatgcgggtccggaaacggctccagcgagcaagagctcaaagccatcgtccgagacctgggttgcggtccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccacgctcagccgcctgtggacttttttgctgtatgttccttcatgcctttgtgcactggcccgaccgtcccatgaacggaaaccccaccatgaagttgctgactggggtgcccaacagcatgctccaatctccccaagtccagcccaccctgcgccgcaaccaggaggcactataccgcttcctaaacacccactcatcttactttcgttctcaccgcgcacgcatcgaaagggccaccgcgtttgaccgtatggatatgcaataa

SEQ ID NO: 432 - DNA, 2823 bp, Adenovirus B16; identical to SEQ ID NO: 194
  MISC_FEATURE (1)..(2823): B16.orf00038 L3 hexon protein

SEQ ID NO: 433 - DNA, 138 bp, Adenovirus B16
  MISC_FEATURE (1)..(138): B16.orf00039 L3 hexon
atgtgcatgtatgcccattggggcatcatcgatggggtggccatcttgaaagcaactcagcctcggcgcgcgacctcttcctttctcctctgctgcggcggcatggtgatgatacatacacacagacaagcaagttaa

SEQ ID NO: 434 - DNA, 753 bp, Adenovirus B16
  MISC_FEATURE (1)..(753): B16.orf00041 L3 protein pVI
atggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccataaaaacctatgggaacaaagcttggaacagcagcacagggcaggcccttagaaataagcttaaggagcagaacttccaacaaaaggtggtcgatggtatcgcctctggtattaacggcgtagtggatctagccaaccaggctgtgcagaaacagataaacagccgcctggacccgccgcccgcaactcctggtgaaatggaagtggaggaagagcttcctccgctggagaagcggggcgacaagcgaccgcgtcccgagctggaacagacgttggtgacgcgcgcagacgagcccccttcatacgaggaggcagtaaagctcggaatgcccactaccaggcctgtagctcacatggctaccggggtgatgaaaccttctcagtcgcatcggcctgccaccttggacttgcctcctccccctgcttctgcggcgcctattcccaaacctgtcgctaccagaaagcccaccgccgtacagcccgtcgccgtagccagaccgcgtcctgggggcacaccgcgcccgaaagcaaactggcagagtactctgaacagcatcgtgggtctgggcgtgcagagtgtaaagcgccgtcgctgctattaa

SEQ ID NO: 435 - DNA, 228 bp, Adenovirus B16
  MISC_FEATURE (1)..(228): B16.orf00042 L2 protein X
atggctctcacttgccgccttcgcgtccccattactggctaccgaggaagaaactcgcgccgtagaaggatgttggggcgagggatgcgccgccacagacgaaggcgcgctatcagcaagcgattagggggtggctttctgccagctcttatacccatcatcgccgcggcgatcggggcgataccaggcatagcttccgtggcggttcaggcctcgcagcgccactaa

SEQ ID NO: 436 - DNA, 1053 bp, Adenovirus B16
  MISC_FEATURE (1)..(1053): B16.orf00044 L2 protein V
atgtccaagcgcaaatacaaggaagagatgctccaggtcatcgcgcctgaaatctacggtccgccgatgaaggatgaaaaaaagccccgcaaaatcaagcgggttaaaaaggacaaaaaagaagaagatggcgatgatggactggtggagtttgtgcgcgagttcgcgccaagacggcgcgtgcagtggcgcggtcgaaaagtacgccaagtgcttagacccgggaccactgtggtctttacacctggcgagcgttccagcactacttttaaacggtcctatgatgaggtgtatggggatgacgatattattgagcaggcggcagaccgccttggcgagtttgcttatggcaagcgcacaagatccagtcccaaagaggaggcggtatctattcccttggatcatggaaatcccacccctagcctcaaaccagtcaccctgcagcaagtgctgcccgtacctgcgagcagaggcgtaaagcgcgagggtgaggacctatatcccaccatgcagctaatggtgcccaagcggcagagattagaagacgtactggagaaaatgaaagtggatgccgatatccagcctgaggtgaaagtgagacccatcaaggaagtggcgccaggtttgggagtacaaacctttgacatcaagattcccactgagtccatggaagtgcagaccgaacctgcaaaacccacagtcacctcaattgaggttcagacggaaccctggatgcccgcgcccgttgccgcccccagcaccactagaagatcacgtcgaaagtatggcccagcaagtctgctaatgcccaactatgctctgcacccatccatcattcccactccgggttacagaggcactcgctactatcgaagtcggagcaacacctcacgccgccgcaaactacctgcaagtcgcactcgccgtcgccgccgccgcaccactgccagcaaattaactcccgccgccctggtgcggagagtgtaccgcgatggtcgcgctgaacctctgacgctgccgcgcgcgcgctatcatccaagcatcaccacttaa

SEQ ID NO: 437 - DNA, 579 bp, Adenovirus B16
  MISC_FEATURE (1)..(579): B16.orf00045 L2 protein VII
atgtccattctcatctcgcccagtaataataccggttggggactgcatgcgcccaccaagatgtacggaggcgcccgcaaacgctctacccagcaccccgtgcgcgttcgcggtcatttccgcgctccctggggcgccctcaagggccgtacccgcactcggaccacggtcgatgatgtgatcgaccaggtggttgccgatgctcgtaattatactcctactgcgcctacatctactgtggatgcagttattgacagtgtagtggcagacgctcgcgcctatgctcgccggaagagccgaaggaggcgcatcgccaggcgccacagggctactcccgctatgcgagctgcaaaagctattctgcggagggccaaacgtgtgggacgaagagccatgcttagagcggccagacgcgcggcttctggtgctagcagcggcaggtcccgcaggcgcgcggccacggcggcagcagcggccattgccaacatggcccaaccgcgaagaggcaatgtgtattgggtgcgcgatgccactaccggccagcgcgtgcccgtgcgcacccgcccccctcgcacttag

SEQ ID NO: 438 - DNA, 1668 bp, Adenovirus B16; identical to SEQ ID NO: 166
  MISC_FEATURE (1)..(1668): B16.orf00047 L2 penton protein

SEQ ID NO: 439 - DNA, 1767 bp, Adenovirus B16
  MISC_FEATURE (1)..(1767): B16.orf00048 L1 protein IIIa
atggaacaacagcaggcaccggaccccgcaatgcgggcggcgctacagagccagccgtccggcattaactcctcggacgattggacccaggccatgcaacgtataatggcgctgacgacccgcaaccccgaagcctttagacagcaaccccaggccaaccgcctttcggccatactggaggccgtagtgccctcccgctccaaccccacccacgagaaggtcctggctatcgtgaacgcgctggtggagaacaaggccatccgtcccgatgaggccgggctggtatacaatgctcttttggagcgcgtggcccgttacaacagcagcaacgtgcagaccaacctggaccggatggtgaccgatgtgcgcgaggctgtgtctcagcgcgagcggttccagcgcgacgccaacttggggtcattggtagcgctaaacgctttccttagcacccagcccgccaacgtgccccgtggtcagcaagactatacaaactttttgagtgcattgagactcatggtatctgaggtgccccagagcgaggtgtaccagtccgggccagattacttcttccagaccagcagacagggcttgcagacagtgaacctgacccaggctttcaagaacctgaagggtctgtggggagtgcacgccccagtaggagatcgcgcgaccgtgtctagcttgctgactcccaactcccgcctgctgctgctgctggtatcccccttcactgacagcggtagcatcgaccgcaactcctacttgggctacctgcttaacctgtatcgcgaggctataggacagagccaggtggacgagcagacctatcaagaaatcacccaagtgagccgcgccctgggtcaggaagacacaggcggtttggaagccaccctgaacttcttactaaccaaccggtcgcagaagatccctcctcagtatgcgcttaccgctgaggaggagcggatcctaagatacgtgcaacagagcgttggactgtttttgatgcaggagggggcgacacctaccgccgcgctggatatgacagctcgaaacatggagcccagcatgtatgctagtaacaggcctttcattaacaaactgctggactacctgcacagggcggccgccatgaactctgattatttcaccaatgctattctgaacccacactggctgcccccacctggtttctacactggcgaatacgacatgcccgatcccaatgacgggttcctatgggacgatgtggacagtagcatattttccccgccgccaggttatacggtttggaagaaggaagggggcgatagaaggcactcttccgtatcgttgcccggaacggctggtgctgccgcggccgtgcccgaagctgcgagtcctttccctagcttgtccttttcactaaacagcgttcgcagcagtgaactggggagaataaaccgcccgcgcttgatgggcgaggatgagtacttgaatgactctttgctgaggccagagagggaaaagaacttccctaacaatggaatagagagcctggtggataagatgagtagatggaagacctatgcgcaggatcacagagacgagcccaggatcttgggggctacaagcagaccgagccgtagacgccagcgccacgacaggcagatgggtcttgtgtgggacgacgaggactctgccgatgacagcagcgtgttggacttgggtggaaaaggagttggcaacccgttcgctcatctgcgtccccgtttcggtcgcatgttgtaa

SEQ ID NO: 440 - DNA, 1170 bp, Adenovirus B16
  MISC_FEATURE (1)..(1170): B16.orf00049 L1 55 kDa protein
atgcatcccgtgctgcgacagatgcgcccccagcaacagcccccttctcagcagcagctacaacaacagccacaaaaggctcttcctgctcctgtaactactgcggctgcagccgtcagcggcgcgggacagcccgcctatgatctggacttggaagagggcgagggattggcgcgcctgggggctccatcgcccgagcggcacccgcgggtgcaactaaaaaaggactctcgcgaggcgtacgtgccccaacagaacctattcagggacaggagcggcgaggagccagaggagatgcgagcatctcgatttaacgcgggtcgcgagctgcgccacggtctggatcgaagacgggtgctgcaagacgaggattttgaggtcgatgaagtgacagggatcagcccagctagggcacatgtggccgcggccaacctagtctcggcctacgagcagaccgtgaaggaggagcgcaacttccaaaaatcttttaacaaccatgtgcgcaccctgatcgcccgcgaggaagtgaccctgggtctgatgcacctgtgggacctgatggaggctatcacccagaaccccactagcaaacccctgacagctcagctgtttctggtggttcaacatagcagggacaacgaggcattcagggaggcgttgttgaatatcaccgagcctgatgggagatggctgtatgatctgattaacatcctgcaaagtattatagtgcaggaacgtagcctgggtttggctgagaaagtggcagctatcaactactcggtcttgagcctgggcaaatactacgctcgcaagatctacaagaccccctacgtacccattgacaaggaggtgaagatagatgggttttacatgcgcatgactctcaaggtgttgactttaagcgacgatctgggggtgtatcgcaatgacaggatgcaccgcgcggtgagcgccagcaggaggcgcgagctgagcgacagagaacttatgcacagcttgcaaagggctctaacgggggccggaactgatggggagaactactttgacatgggagcggacttgcaatggcaacccagtcgcagggccatggaggctgcagggtgtgagcttccttacatagaagaggtggatgaagtcgaggacgaggagggcgagtacttggaagactga

SEQ ID NO: 441 - DNA, 1923 bp, Adenovirus B16
  MISC_FEATURE (1)..(1923): B16.orf00055 E2B terminal protein
atgaactacttcatgccgctgcgcaacatctggaaccgcgtacgcgagttcccgcgggcatccaccaccgcctccggtatcacctggatgtccaggtacatctacggttatcaccgcctcatgctggaagacctcgcccctggcgccccggctacagagcgatggcccctataccgccagccgccgcctcactttctcatcggctaccagtacctggtgcgcacctgtaacgattacatctttgacacccgcgcctactcgcgcctcaagtacaccgagattgtgcgtccggggcaccagacagtcaactggtcagtcatggccaactgctcctacacaatcaacaccggggcttaccaccgcttcgtggactttgacgacttccaagccaccctcacccaggtgcagcaagccatcctcgcagaaagggttgtagcggacctggcacttgtccagcccatgcgcgggttcgggatcactcgcatgcatggcagagcgggcgaagaagaagtgcccgtggaacgactcatgcaagactactataaagatctggccagatgtcaggataatgcttggggaatggcccatcgcctgcgcatccaacaagccggacccaaagacctggtgctcctcgccaccatccgccgtctcaaaactgcctattttaatttcatcaccagcagcatcgtctcaccctccaaagaggaggaaggagaagaaagagagaaccccgaccgagcgtctagccgcccccgcccgcaagaaacagtgctcagcctaccttgcgattgcgactggttagacgctttcgtcgaaaggttttcagatcccgtggatcttgagacgatcaggtccttgcgcggagtacctacggggcaattgataaaatgcataatcagcgcggtgtccctgcccaacggagagcctcccagtcaccacttcagggagatgcgcggaggcgtcttcactctgagacccagggagaacggtcgtgccgtcaccgagaccatgcgccgccgccgcggagaggtcattgaaagattcatcgaccgtctgcctgtgcgccgccggcgtcgccgcgttccccctcctcctgcagccccacctgaagaggaagagatgttagtggaagaagaagaaattgaggaagaaatcccgggggctttcgagcgcgaggtgcgcaccaccatcgccgaactcatccgtcttctggaagaggagttgaccgtgtccgcgcgtaactcccagtttttcaactttgccgtggacttctacgaggccatggagcgcttggaagcgctgggcgatgttagcgagatgccgctgagacgatggatcatgtatttcttcgtcaccgagcacatcgccaccacactcaactaccttttccagcgcctatgcaactatgcggtcttcacccgccacgtggagctcaacctcgcccaggtggtcatgcgcgcgagagatcccgagggggctgtggtctacagccgcgtctggaacgaggcgggcatgaatgcattctctcaactcattggacgcatctccaacgaccttgcggccaccgtcgagagagcgggccgcggagatcttcaagaggaagagatcgagcagttcatggccgagatcgcctaccaggacaactctggcgacgtgcaagaaatccttaggcaagccgccgtcaacgataccgagattgattctgttgaactctctttcaggttcaagctcacggggccggtagcgttcacccagaggcgtcagatccaggatgtcaaccgccgcgtcgtcgcgcatgcaagtcttctcagggcgcagtaccagaacctacccgcgcgcggcgccgacgtaccactgccggccatgccgccgggtcccgagccgcccctgccgcccggtgcgcgccctcgacaccgcttctaa

SEQ ID NO: 442 - DNA, 3369 bp, Adenovirus B16
  MISC_FEATURE (1)..(3369): B16.orf00056 E2B DNA polymerase
atgcaagaagcaacagagccaccgccgcccaaacggaaaaacaagggcacggtggtagcgcccaaggggcacggaaccctgcaagccatcgacatctccaccaacggacccgtggagatcaagtaccatctgaacctccctcacgccctcgaaaagatcatgcaagtcaatctcctgacactgcctactaacctgactccgcagcgtctcaggaccctggacagctccgacctgcgcgctctcgtcctcgagctccgcccctgccgcgccgaggtctggacttgcctcccgcgagggctcgtcagcatgaccaccatcgagacagaagatggtcatgccgatgcagacaacatagtagagcgcgaggtacaagcgccaggcctcaattttccactgaaatttctcgtcaaaggaagtcaggtacaactcattcatgaggtgcatcccgtgaatcgatgcgagtactgcggccgtctgtacaagcacaagcatgaatgctcggcgcgtcgcagggagttctacttccatcacatcaacagccattcctccaactggtggcaggagatccagttcttcccgattggctctcatcctcgcacagaaaggctcttcctcacctacgatgtggaaacctacacctggatggggtcctttggcaagcagctaatccccttcatgctggtcatgaaactctctggagaccagcggctcgtcaacatcgcctatgacctggctataaaactcaagtgggatcgctggcagcaggacccccaaaccttctattgcgtcaccccagaaaagatggcagtcgggcagcattttcgtcagtaccgggaccagttacaaacagcactggcagtggacctctggtcctccttcctcaaagcgaaccctcacctgcacgaatgggccctcgaacactatgctctcactgaccctacagacctcacttttgaagaactcaagaagctgcctcatgtcaggggcacacctcgattcttagaactgtacatagtggggcacaacatcaatggctttgatgagatcgtcttggccgctcaggttatcaataaccgagcagaggtccctcagcctttcagaatcacccgaaattttatgcccagggccggcaagatcctcttcaatgatgttactttcgctttgcccaaccccgcctacaagaagcgggtggacttccaactctgggaacagggggcctgtgatgacatcgacttcaagtatcaattcctcaaagtcatggtcagggacacttttgccctcactcatacctcgctgcgcaatgcagcccaagcatactctctcccagtggagaagggatgctgtccctacaaggcagtcaatcaattctacatgttgggctcttaccgtgcagaaaaagacgggtttcccctcgaagagtactggaaggatcgcgaagaataccttctcaaccgcgagctgtgggaaaagaaaaaccaaccgcgttatgacatcatccaggaaactctcgactactgtgccctagacgtacttgtcaccgccgagctggtagccaagctgcaagagtcatatgcccacttcataagggactctgtaggcctccctcatgcccattttaacatattccagagacctactatctcttccaattcccatgccatctttcgccagatcgtttacagggcggaaaaacccaaccgcaccaatctgggcccgggtcttctcgccccctcacatgaactctatgactatgtgcgagcaagcatcagaggggggcgctgttatcccacttacatcggcatcctcgaagagcccctctatgtctacgatatctgtggcatgtatgcctccgcgctcacccaccccatgccctggggcacccctcttaacccctatgagcgcgcgctggcagttcgagaatggcagatgactttggatgatcccgccaccatcagctattttgacaaggatttgctaccgggaatatttaccatagatgcggacccccctgatgagttcatgctagaccccctcccccctttctgttcaagaaaaggaggtcgactctgctggaccaatgagcccctccgaggcgaggtagccaccagtgtggatctgataaccctgcacaataggggatggcgagtcagaatagttccggatgaactgacaaccatcttccctgaatggaaatgtgtggcgcgcgagtacgtccagcttaacatcgccgccaaggagcgcgcggacaaggaaaagaaccaaaccatgcgctctatcgccaagcttctatccaatgccctctatggatcatttgccaccaagctggacaacaagaagattgtgttttctgaccagatggacgagagtcttatgaaaggcatctctgctggtactgtcaatatcaaatcctcctcgttcctagaaactgacaacctgagtgcagaggtcatgcccgccttcgagagggaatacctaccccaacagctggcgctcctggacagcgatccggaagacagtgaagacgaacagaggcccgcccccttttatacccccccggcggggacccctggtcacgtggcctacacttacaagccaatcacattcttggatgtggaggagggggacatgtgtttacataccgtagagaaggtggaccccctggttgacaacgaccgctacccctcccacgtggcctcctttgtgctggcctggacacgcgcttttgtatcagagtgggctgggttcctctacgaagaggaccgcggcactccgctcgaggacaggcccataaagtcagtctacggggacacggacagcctctttgttacccagcggggacacgaactcatggaaaccaaaggtaagaaacgcatcaaaaaacatggcggaaaacttgtttttgaccccgatgagccggatctgacatggctcgtggagtgcgaaaccgtctgcgcctcctgcggtgcggatgcatactcccccgaatccattttcctcgcgcccaagctgtatgccctcaaatgtatctactgccccgcctgccataaaacttccaaaggtaagctccgtgccaaaggccacgcggccgaggcgctcaactacgaactcatggtaaactgctacctggccgacatgcagggcgccgatcggcagcggttctcgaccagcaggatgagtctgaagcgcaccctcgcaagcgcccaaccaggcgcgcaccccttcaccgtgacggaaacaaccctgactcggacgctgcgaccatggaaggatcggaccctggcagcgctggacgcccatcgtctgattccctactccaggagccgtcccaacccgcgaaacgaggaggtctgctggatcgagatgccatag

SEQ ID NO: 443 - DNA, 1047 bp, Adenovirus B16
  MISC_FEATURE (1)..(1047): B16.orf00057 IVa2 protein IVa2
atgcccatggctgacgggctgaagccgctgaaaaacttctcctcgctccaggagcttctatcccttgggggagagcgcctcctaacggacttggtgcgggaaaatatccatgtaagggaaatgatgaacgaagtggcccccctgctccgggaggacggcagctgtcgctccctaaactaccatctgcaacccgtaattggggtcatttacggtcccactgggtgcggcaagtctcagctgcttaggaatttgctctcatcccagttaatcaccccggctccagaaacagtattttttatagccccgcaggtggatatgatccccccctctgaactgaaagcctgggaaatgcaaatatgtgagggaaactatgctcccgggccagagggaactttcatcccccaatctggcacccttcgcccaaagtttattaaaatggcttatgatgacctgactcaggagcataactatgatgtttcagacccccggaacgtgttcgcccgtgccgctgcccacggccccatcgctatcattatggatgagtgcatggagaatctggggggtcacaaaggcgtctccaaattttttcatgcttttccctctaagctgcatgataaatttcccaagtgcaccggatacactgtcttggtggttctgcacaatatgaaccccagacgggatctaggcggcaacattgccaacctcaagatccagtccaaaatgcatataatttcaccccggatgcacccgtcccagctcaacagatttgtaaacacctacactaagggcctccccgttgcaattagtctgctcctaaaagatattgtgcaacaccatgcactccgaccttgctatgactgggtgatttataacactaccccggagcaagaggctcttcaatggagctatctccacccccgggacggactaatgcccatgtatctaaacattcaatcccacctttacagggtactggaaaagatccaccgagttctcaatgatcgagaccgatggtccagggcataccgcgcgcgaaaaatcaaataa

SEQ ID NO: 444 - DNA, 417 bp, Adenovirus B16
  MISC_FEATURE (1)..(417): B16.orf00059 IX hexon-associated protein IX
atgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattacggaagcatcgttgccaattccagttcctctaataacccttcaaccctggctgaggacaagctacttgttctcttggctcagctcgaggccttaacccaacgcttaggcgaactgtctaagcaggtggcccagttgcgtgagcaaactcagtctgctgttgccacagcaaagtctaaataa

SEQ ID NO: 445 - DNA, 1479 bp, Adenovirus B16
  MISC_FEATURE (1)..(1479): B16.orf00060 E1B large T antigen
atggatccgccaaacccacttcagcaagggatacgttttggatttcatagcagcagctttgtggagaacatggaaggctcgcaggatgaggacaatcttagattactggccagtgcagcctctgggagtagcagggatactgagacacccaccggccatgccagcggttctggaggaggagcagcaggaggacaatccgagagccggcctggaccctccggtggaggagtagctgacttgtttcctgaactgcgacgggtgcttactaggtctacgtccagtggacaggacaggggcattaagagggaaaggaatcctagtgggaataattcaagaaccgagttggctttaagtttaatgagccgtaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacagtatagaattactaagaagattaatattagaaatgcatgctacatatcagggaatggggcagaggttataatagatacacaagataaagcagcttttagatgttgtatgatgggtatgtggccaggggttgtcggcatggaagcagtaacatttatgaatattaggtttaaaggggatgggtataatggcattgtatttatggctaacactaagctgattctacatggttgtagcttttttgggtttaataatacttgtgtagaagcttgggggcaagttagtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcgaatgagaggccttatcagatgctgacctgcgctggtggacattgcaatattctggctaccgtgcatatcgtttcccatgcacgcaagaaatggcctgtatttgaacataatgtgattaccaagtgcaccatgcacataggtggtcgcaggggaatgtttatgccttaccagtgtaacatgaatcatgtgaaggtgatgttggaaccagatgccttttccagagtaagcttaacaggaatctttgatatgaatattcaactatggaagatcctgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagttcggttctagtggtgaagaaactgactaa

SEQ ID NO: 446 - DNA, 141 bp, Adenovirus B16
  MISC_FEATURE (1)..(141): B16.orf00061 E1B 20 kDa small T antigen
atgaaatccaaaacgtatcccttgctgaagtgggtttggcggatccatttatccaatataaaagtaagaaaagctacagcagcagcagttctaccaggagtagaaaaatctaaaactgataaaaccttctccttaaaatga

SEQ ID NO: 447 - DNA, 126 bp, Artificial Sequence
  B16.orf00063 hypothetical protein
atggcagcaggttgctatgagctaaccacacagatctgctcctacttatatatccaagtccccacccaagaagcaataaaacactcagcagctgacataattttattacatgacgtcactaaataa

SEQ ID NO: 448 - DNA, 201 bp, Adenovirus B16
  MISC_FEATURE (1)..(201): B16.orf00064 E1A 25.7 kDa protein
gtgtctgatgatgagtcaccttctcctgattcaactacctcacctcctgaaattcaggcgcccgtacctgcaaacgtatgcaagcccattcctgtgaagcctaagtctgggaaacgccctgctgtggataagcttgaggacttgttggagggtggggatggacctttggaccttagtacccggaaactgccaaggcaatga

SEQ ID NO: 449 - DNA, 594 bp, Artificial Sequence
  B16.orf00066 E1A hypothetical protein
atgagacacctgcgattcctgccacaggagattatctccagcgagaccgggatcgaaatactggagtttgtggtaaataccctgatgggagatgacccggaaccgccagtgcagcctttcgatccacctacgctgcacgatctgtatgatttagaggtagacgggcctgatgatcccaatgaggaagctgtaaatgggttttttactgattctatgctgctagctgccgatgaaggattggacataaaccctcctcctgagacccttgataccccaggggtggttgtggaaagcggcagaggtgggaaaaaattgcctgatctgggagcagctgaaatggacttgcgttgttatgaagagggttttcctccgagtgatgatgaagacggggaaactgaacagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaa

SEQ ID NO: 450 - DNA, 378 bp, Adenovirus B21
  MISC_FEATURE (1)..(378): B21.orf00002 E4 14.2 kDa protein
atggctgatgaggctttgtatgtgtatttagatggaccgggggcgacgttgcctgaacagcggcagagaaataattatattttttattctcctgtgccttttactttgtatccgcgaggggtggctttgctatacttaagattaagcataattatacccagaggctatgttggctgttttttctctttaactgatgctaacatgtctggattatatgcttcatcaagaattattcatgctggccaccgcgaggaactttcggtgctgttgtttaatcacgatgacaggttttacgagggtcgagctggagaccctgtggcttgtcttgtgatggaaagactgatttatccacctgttcgacaggctactatgatatga

SEQ ID NO: 451 - DNA, 435 bp, Adenovirus B21
  MISC_FEATURE (1)..(435): B21.orf00003 E4 ORF2 protein
atgacgcttgtttcttttattttgcagactaattcaaaactaacaatgttggagcgcagcgcggtaacctattgcatttgcatcccagagattttgaatgtttctttggaaaatttttcttttattcaatttttacaagaaactctgcctgattatatttccagcaactttgatgatattactggtggttcccagtatgcttattctaatcttgtttttgctggagccaattggggaggtctgcgcttgtactgcactgtagcgtcccctgctattgttcccggggggcttttggctaagcagtttggtgataatatgagagagtatttacaactagaacttagagaagaacttagagccaagggcatgtcaattgatgatgccattcttaatttgctacaggtgacacaggagcaagatattttgtcattatga

SEQ ID NO: 452 - DNA, 354 bp, Adenovirus B21
  MISC_FEATURE (1)..(354): B21.orf00004 E4 ORF3 protein
atgagggtgtgtttaagaatggtggtggagggcgccctccgtgacctgtttgtaatgtgtggtttggatttaccacaagaactgacacgaataattcaaggctggaaagctgaaaattatctgggaatggtgcaggaatgtaatatgatgtttgaggagttagaaaatgctccttcttttggtattcttttgtttttggatgtgcgcgtggaggctttgttggaagccaccgttgagcaccttgaaaatcgcatttcttttgatttagctgtgctttttcaccaacacagtgggggcgatagatgccatctgcgcgatctacaatttgaagtactgcgagatcgtttggaataa

SEQ ID NO: 453 - DNA, 900 bp, Adenovirus B21
  MISC_FEATURE (1)..(900): B21.orf00008 E4 ORF6 protein
atgtcaggaaacaactccattatgacaaggttgcgcgcacgctcgacatcatgcgccagacatcacccttacaccagagcccagttaccacgatgtgaggaaaatgaaacccgagcttctatgactgaagaccacccgctgttgccagattgtgatactatgactatgcatagtgtaagttgtgttcgtggtcttccttgttctgccagctttactgttttgcaagagtttcccattccttgggatatgtttttaaatccagatgagttaaaaattatgagaagatgcatgcatttatgtctttgttgtgctactatagatatttttcagtctcaagtgattcatggtcgagagaattgggttcttcattgtcattgtaatcagcagggttcacttcaatgcatggctgggggagcggtgttggcagtgtggttccggaaggttatattgggttgcatgattaaccaacgttgtccatggtacagacagattgttaatatgcacatgccaaaagagatcatgtatgtgggtagtgtgtttttgagggaacgacatttaatttatattaaaatttggtatgatggtcatgcaggggcgattgtatcagatatgagttttggctggagcgcttttaattatggtttattaaacaatattgtgataatgtgctgtacatactgtagtaatctaagtgaaatcagaatgcgttgctgcgcgcatcgcaccagaaagttaatgttaagggctattaaaatcatgcttcaggacactgcagaccccgatcccataaacagcagtcgcacggagcgacgcagacagcggctgcttgtgggtttgatgagacacaatcgcccgattccgttttcggattatgattcccatcgttcttcttccagatga

SEQ ID NO: 454 - DNA, 252 bp, Adenovirus B21
  MISC_FEATURE (1)..(252): B21.orf00009 E4 ORF6/7 protein
atgactgtgatccagactccggagtcgcatccgcagcagttggactgtgaaagcgctttaaaagactatcccgatgcatttttatgtatcactgaccccagattggctcgctctgaaactgtttggaatgtggaaactaaaactatgtctatctctaatggtatccaaatgtttaaagctgtgcgtggggagagattggtgtattctgttaaatgggaagggggaggcaaaataactactcgaattttgtga

SEQ ID NO: 455 - DNA, 972 bp, Adenovirus B21; identical to SEQ ID NO: 135
  MISC_FEATURE (1)..(972): B21.orf00010 L5 fiber protein

SEQ ID NO: 456 - DNA, 165 bp, Adenovirus B21
  MISC_FEATURE (1)..(165): B21.orf00011 U protein
atgaagatcgtgggtacaggagaggagctaaaatttgacatcccatttaaagtatggagaaagtatgccgctgaacggggtttagaataccagagttgggaagagggaagcgaggtgctgctgggaaaaaatttcaacagagaccttattgctgatttcaagtaa

SEQ ID NO: 457 - DNA, 408 bp, Adenovirus B21
  MISC_FEATURE (1)..(408): B21.orf00014 E3 15 kDa protein
atgactgaaatactcaccacctccaattccgccgaggatctgcttgatatggacggccgcgcctcagaacagcgactcgcccaactacgcatccgccagcagcaggaacgcgtgaccaaagagctcagagatgtcatccaaattcaccaatgcaaaaaaggcatattttgtttggtaaaacaagccaagatatcctacgagatcaccgctactgaccatcgcctttcttacgaacttggcccccaacgacaaaaatttacatgcatggtgggaatcaaccctatagttatcacccagcaaagtggagatactaagggttgcattcactgctcttgcgattccaccgagtgcacctacaccctgctgaagaccctatgcggcctaagagacctgctacccatgaattaa

SEQ ID NO: 458 - DNA, 438 bp, Adenovirus B21
  MISC_FEATURE (1)..(438): B21.orf00016 E3 16.5 kDa protein
atgttgcggcacttcttaggcttatttaaaaccatgcaggctatgctaccagttattttaattctgctactaccctgcattgccctaccttccaccgccactcgcgctacacctgaacaacttagaaaatgcaaatttcaacaaccatggtcatttcttgattgctaccatgaaaaatctgattttcccacatactggatagtgattgttggaataattaacatactttcatgtaccgttttctcaatcacaatataccccacatttaattttgggtggaattctcccaatgcactgggttacccacaagaactagatgaacatatcccactacaacacatacaacaaccactagcattggtagagtatgaaaatgagccacaaccttcactgcctcctgctattagttacttcaacctaaccggcggagatgactga

SEQ ID NO: 459 - DNA, 276 bp, Adenovirus B21
  MISC_FEATURE (1)..(276): B21.orf00018 E3 10.3 kDa protein
atgattcctagaaatttcttcttcaccatactcatctgtgctttcaatgtctgtgctactttcacagcagtagccactgcaagcccagactgtataggaccatttgcttcctatgcactttttgcctttgttacttgcatctgcgtgtgtagcatagtctgcctggttattaattttttccaactggtagactggatctttgtgcgaattgcctacctacgtcaccatcccgaataccgcaatcaaaatgttgcggcacttcttaggcttatttaa

SEQ ID NO: 460 - DNA, 285 bp, Adenovirus B21
  MISC_FEATURE (1)..(285): B21.orf00020 E3 11 kDa protein
atgatattgtttcaatcaaatgccactaacactctcaatgtgcagactactttaaaacatgacatggaaaaccacactacctcctatgcatacacaaatattcagcctaaatacgctatgcaactagaaatcaccatactaattgtaattggaattcttacactatctgttattctttattttatattctgccgtcaaatacccaatgttcatagaaattctaaaagacgtcccatctattctcctatgattagtcgtccccatatggctctgaatgaaatctaa

SEQ ID NO: 461 - DNA, 570 bp, Adenovirus B21
  MISC_FEATURE (1)..(570): B21.orf00022 E3 20.8 kDa protein
atgatttccactacaatttttatcattactagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtacaaaattttcatgcaacggaagagacttgaccattattaacataacattaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttcgaaaaatcgctttaagtaattccacagcagctcccaatacaattcctaaatcaacaattggcatcattactgccgtggtagtgggattaatgattatatttttgtgcataatgtactacgcctgctgctatagaaaacatgaacaaaaaggtgatgcattactaaattttgatatttaa

SEQ ID NO: 462 - DNA, 540 bp, Adenovirus B21
  MISC_FEATURE (1)..(540): B21.orf00023 E3 20.1 kDa protein
atggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactgaaccaatatttgtaatctgtaacagacaaaatctcacgttaattaatgttagcaaaatttataacggttactattatggttatgatagatccagtagtcaatataaaaattacttagttcgcataactcagcccaaatcaacagtgccaactatgacaataattaaaatggctaataaagcattagaaaattttacattaccaacaacgcccaatgaaaaaaacattccaaattcaatgattgcaattattgcggcggtggcattgggaatggcactaataataatatgcatgttcctatatgcttgttgctataaaaagtttcaacataaacaggatccactactaaattttaacatttaa

SEQ ID NO: 463 - DNA, 519 bp, Adenovirus B21
  MISC_FEATURE (1)..(519): B21.orf00024 E3 19.2 kDa protein
atgggggccatactagtcgtgcttgctttactttcgcttttgggtctgggctctgctaatctcaatcctcttgatcacgatccatgtctagacttcgacccagaaaattgcacacttacttttgcacccgacacaagccgtctctgtggagttcttattaagtgcggatgggactgcaggtccgttgaaattacacataataacaaaacatggaacaatacattatccaccacatgggaaccaggagttcccgagtggtatactgtctctgtccgaggtcctgacggttccattcgcattagtaacaacactttcattttttctgaaatgtgcgatctggccatgtttatgagcaaacagtatgacctatggcctcctagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaa

SEQ ID NO: 464 - DNA, 321 bp, Adenovirus B21
  MISC_FEATURE (1)..(321): B21.orf00027 E3 11.7 kDa protein
atgtctaatggtggcgcggctgagctagctcgactgcgacacctagaccactgccgccgctttcgctgtttcgcccgggaactcaccgagttcatttacttcgaactctccgaggagcaccctcagggtccggcccacggagtgcggattaccatcgaagggggaatagactctcgcctgcatcgcatcttctcccagcggcccgtgctgattgagcgcgaccagggaaatacaaccatctccatctactgcatctgtaaccaccccggattgcatgaaagcctttgctgtcttgtttgtgctgagtttaataaaaactga

SEQ ID NO: 465 - DNA, 684 bp, Adenovirus B21
  MISC_FEATURE (1)..(684): B21.orf00028 L4 pVIII protein
atgagtaaagacattcccacgccttacatgtggagctatcagccccaaatggggttggcagcaggtgcttcccaggactactccacccgcatgaattggcttagcgccgggccctcaatgatatcacgggttaatgatatacgagcttatcgaaaccagttactcctagaacagtcagctcttaccaccacaccccgccaacaccttaatccccgaaattggcccgccgccctggtgtaccaggaaaatcccgctcccaccaccgtactacttcctcgagacgcccaggccgaagttcagatgactaacgcaggtgtacagctggcgggcggttccgccctatgtcgtcaccggcctcaacagagtataaaacgcctggtgatcagaggccgaggtatccagctcaacgacgagtcggttagctcttcgcttggtctgcgaccagacggagtcttccagatcgccggctgtgggagatcttccttcactcctcgtcaggctgtgctgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattga

SEQ ID NO: 466 - DNA, 297 bp, Adenovirus B21
  MISC_FEATURE (1)..(297): B21.orf00029 L4 33 kDa protein
gtgaccagaaaaccagcagttagaaaatccacaacaagtgcagcaggaggaggactgaggatcacagcgaacgagccagcgcagaccagagagctgaggaaccggatctttccaaccctctatgccatcttccagcagagtcgggggcaagagcaggaattgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtag

SEQ ID NO: 467 - DNA, 129 bp, Adenovirus B21; identical to SEQ ID NO: 428
  MISC_FEATURE (1)..(129): B21.orf00030 L4 22 kDa protein

SEQ ID NO: 468 - DNA, 2472 bp, Adenovirus B21
  MISC_FEATURE (1)..(2472): B21.orf00031 L4 100 kDa hexon-assembly associated protein
atggaaactcagccatcactgccaacatcgctgcaagcgccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaccaggaggctggcctcggggatcatgttgccgactacctctccgggcttgggggggaggacgtgctcctcaaacatctagcaaggcagtcgatcatagttaaagacgcactactcaacctcaccgaagtgcccatcagtgtggaagagcttagccgcgcctacgagctgaacctcttttcgcctcagataccccccaagcggcagcgaaacggcacctgcgaggccaaccctcgactcaacttctatccagcttttactgtccccgaagtgctggccacctaccacatcttttttaagaaccaaaagattccagtctcctgccgcgccaaccgcacccgcgcagatgcccttctcaacttgggtccgggagctcgtttacctgatatagcttccttggaagaggttccaaagatctttgagggtctgggaagtgatgagactcgggccgcaaatgctctgcaacagggagagaatggcatggatgaacatcacagcgctctagtggaactggagggtgacaatgcccggcttgcagtgctcaagcgcagtatcgtggtcacccattttgcctaccccgctgttaacctgccgcccaaagtcatgagcgctgtcatggaccatctgctcatcaaacgagcaagtccactttcagaaaaccagaacatgcaggatccagacgcctcggacgagggcaagccggtagtcagtgacgagcagctatctcgctggctgggtaccaactccccccgagatttggaagaaagacgcaagcttatgatggctgtagtgctagtaactgttgagttggagtgtctgcgccgcttttttaccgaccccgagaccctgcgcaagctagaggagaacctgcactacaccttcagacatggcttcgtgcgccaggcatgcaagatctccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaaccttaaagagctggacaagctcttgcagagatccctcaaagccctgtggacaggttttgacgagcgcaccgtcgcctcggacctggcggacatcatcttccccgagcgtcttagggttactctgcgaaacggcctgccagacttcatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctattccgcctggccaactacctctcctaccactcggatgtgatagaggatgtgagcggagacggcctgctggaatgccactgccgatgcaatttatgcacaccccaccgctccctcgcctgcaacccccagttgctaagcgagacccagatcatcggcaccttcgagttgcagggtcccaacagtgaaggcgaggggtcttctccggggcagagtctgaaactgacaccggggctgtggacctccgcctacctgcgcaagttttatcccgaggactatcatccctatgagatcaggttctatgaggaccagtcacatcctcccaaagtcgagctctcagcctgcgtcatcacccagggggcaattctggcccaattgcaagccatccaaaaatcccgccaagaatttctgctgaaaaagggaagcggggtctaccttgacccccagaccggtgaggagctcaacacaaggttcccccaggatgtcccatcgccgaggaagcaagaagctgaaggtgcagctgtcacccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtag

SEQ ID NO: 469 - DNA, 1554 bp, Adenovirus B21
  MISC_FEATURE (1)..(1554): B21.orf00033 E2A DNA binding protein
atggccagccgcggaggaaatcagtcaagcgaccgccaacgggagcacacccccgaacgcggaatgggctctgccagccatccgcctccaaggccggaccgcagcccatctcagtcgcctccacctctgcccccgaagaggaacacctaccgtcgcgtggggtccgattcttctatcgagagccaggtggtactggtaagcgaaacttcgcggtcatccctgtctccggaacggagcaacagtcctcccccgatccctcccaagaagaagcccaggaagaccaagcatgtccctctgcaagacatcagccaggacagcgaagaagaaagagaacaggctcagttggtggccgtgggcttcagctaccccccggtgcgcatcattgagaaggatggcaagagaagtgttgagaagatcgacaagaatgaccctatagctaaaggagctacttctattgctgttaggaatcctttgagcttgcccctggtatctgcctgggagaagggcatggaagtgatggctgtgctaatggagaggtataggctggataatgacctgagaacctctttcaagctgatgccagagcagcacgagcagtacaagcgtatctgccaccagtatgtgaacgaggagcaccgtggcatcccgctgacatttagtagcatgaagaccctgacagcgatgatgggaagattcatgcagggattggtgcattcttattctgagatcgcccacaataattgggagtgcaccgggtgcgctctgtgggctcatggatgcaccgattacgaaggcaaggtgaaatgcctgcatggcactattatgatccagaaggaccacattatcgagatggatgtggcgagcgaaaacgggcagcgcgctatgaaggagaacccagacagagccaagatcacccagaaccgctggggcagaaatgtggtccagttggccaacaacgatgcccgctgctgtgtgaatgatgccaactgtgctactaaccaattttccagcaagtcctgtgggatgttttacaccgagggaagtaaggctcaggaagctttcaagcagtacgaagccttcatgaaggccgtgtacccagggataacccccgaccaagccaggatgatgctgatccccattcattgcgattgcaaccacaagccaggctgcgctcccgtgatgggcaggcagacctgtaagatgaccccctttggaatggccaatgctgaagacttggatgtgactaccatcagtgacccgaccgtgctggcaagcgtgagacacccagccttgatggtgttccagtgttgcaacccagtgtaccgcaactcccgtgtccagaatgccggccccaactgtgatttcaagatctctgctcctgacctgcttggcgccctgcaactgaccagaaagttgtggcaagacacctttcccgaaattccagttcccaagctggtgatccccgagttcaagtggcagaacaggttacagttccgcaacgtctccctgcccacgggtcactctgactcacgccagaacccatttgatttctga

SEQ ID NO: 470 - DNA, 630 bp, Adenovirus B21
  MISC_FEATURE (1)..(630): B21.orf00034 L3 23 kDa protein
atgtcatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccgcgctcagccgcctgtggacttttttgctgtatgttccttcatgcctttgtgcactggcccgaccgccccatgaacggaaaccccaccatgaagttgctgactggggtgtcaaacagcatgctccaatcaccccaagtccagcccaccctgcgtcgcaaccaggaggcgctatatcgcttcctaaacacccactcatcttactttcgttctcaccgcgcacgcatcgaaagggccaccgcgtttgaccgtatggatatgcaataa

SEQ ID NO: 471 - DNA, 129 bp, Adenovirus B21
  MISC_FEATURE (1)..(129): B21.orf00035 L3 23 kDa proteinase
atggctttgagctcttgctcgctggagccgtttccggacccgcatgacatggctgcagctgctgcttgcaagaagcaagaggcttcttatgtggtggcgttgccggccgagaacggtgtgcgcaggtag

SEQ ID NO: 472 - DNA, 2850 bp, Adenovirus B21; identical to SEQ ID NO: 195
  MISC_FEATURE (1)..(2850): B21.orf00036 L3 hexon protein

SEQ ID NO: 473 - DNA, 750 bp, Adenovirus B21
  MISC_FEATURE (1)..(750): B21.orf00039 L3 protein VI
atggaagacatcaatttttcatccctggctccgcgacacggcacgaggccgtacatgggcacctggagcgacatcggcaccagccaactgaacgggggcgccttcaattggagcagtatctggagcgggcttaaaaattttggctctaccataaaaacctatgggaacaaagcttggaacagcagcacagggcaggcattgagaaataagcttaaagagcaaaacttccaacagaaggtggttgatggaatcgcctctggtatcaatggggtggtggatctggccaaccaggccgtgcagaaacagataaacagccgcattgacccgccgccgtcagccccgggtgaaatggaagtggaggaagatctccctccccttgaaaagcggggcgacaagcgtccgcgccccgatctggaggagacactagtcacacgctcagacgacccgccctcctacgaggaggcagtgaagcttggaatgcccaccaccagacctgtagcccccatggctaccggggtaatgaaaccttctcagtcacaccgacccgctaccttggacttgcctccccctgctgttgcagcgcctgctcgcaagcctgtcgctaccccgaagcccaccaccgtacagcccgtcgccgtagccagaccgcgtcctgggggcactccacgtccgaatgcaaactggcagagtactctgaacagcatcgtgggtctgggcgtgcaaagtgtaaagcgccgtcgctgcttttaa

SEQ ID NO: 474 - DNA, 231 bp, Adenovirus B21
  MISC_FEATURE (1)..(231): B21.orf00041 L2 protein X
atggccctcacttgccgccttcgtgtccccattactggctaccgaggaagaaactcgcgccgtagaagagggatgttggggcgcggaatgcgacgccacaggcggcggcgcgctatcagcaagaggctggggggtggctttctgcctgctctgatccccatcatagccgcggcgatcggggcgataccaggcatagcttccgtggcggttcaggcctcgcagcgccactga

SEQ ID NO: 475 - DNA, 1062 bp, Adenovirus B21
  MISC_FEATURE (1)..(1062): B21.orf00042 L2 protein V
atgtccaagcgcaaatacaaggaagagatgctccaggtcatcgcgcctgaaatctacggtccgccggtgaaggatgaaaaaaagccccgcaaaatcaagcgggtcaaaaaggacaaaaaggaagaagatggcaatgatggtctggcggagtttgtacgcgagttcgccccaaggcggcgtgtgcagtggcgtggacgcaaagtgcggcctgtgctgagacctggaaccacggtggtctttacgcccggcgagcgctccagcactgcttttaagcggtcctatgatgaggtgtatggggatgatgatattctggagcaggcggccgaccgcctgggcgagtttgcttatggcaagcgctcccgctcgagccccaaggaggaggcggtgtccattcccttggacaatgggaatcccacccctagtctcaagccagtcaccctgcagcaagtgctgcccgtgcctccacgcagaggcaacaagcgagagggtgaggatctgtatcccactatgcaattgatggtgcccaagcgccagcggctggaggacgtgctggagaaaatgaaagtggatcccgatatacaacctgaggtcaaagtgagacccatcaagcaggtggcgccaggtttgggagtacaaaccgtagacatcaagattcccaccgagtccatggaagtccaaaccgaacctgcaaagcccacaaccacctccattgaggtgcaaacggatccctggatgaccgcacccgttacaactccagctgctgtcaacaccactcgaagatcccggcgaaagtacggtccagcaagtttgctgatgccaaattatgctctgcacccatccattattccaactccgggttaccgaggcactcgctactaccgcagcaggagcagcacttcccgccgtcgccgcaaaacacctgcaagtcgtagtcaccgtcgtcgccgccgccccaccagcaatctgactcccgctgctctggtgcggagagtgtatcgcgatggccgcgcggatcccctgacgttgccgcgcgtacgctaccatccaagcatcacaacttaa

SEQ ID NO: 476 - DNA, 579 bp, Adenovirus B21
  MISC_FEATURE (1)..(579): B21.orf00044 L2 protein VII
atgtccattcttatctcacctagtaataacaccggttggggcctgcgcgcgccaagcaagatgtacggaggtgctcgcaaacgctctacacagcaccctgtgcgcgtgcgcgggcacttccgcgctccatggggcgccctcaagggtcgtgcccgcactagaaccaccgtcgatgatgtgatcgaccaggtggtggccgatgctcgtaattatactcctactgcacctacatctactgtggatgcagttattgacagcgtagtggctgacgcccgcgcctatgctcgccggaagagcaggcggagacgcatcgccaggcgccaccgggctactcccgctatgcgagcggcaagagctctgctacggagggccaaacgcgtggggcgaagagctatgcttagagcggccagacgcgcggcttcaggtgccagtgccggcaggtcccgcaggcgcgcagccacggcggcagcagcggccattgccaacatggcccaaccgcgaagaggcaatgtgtactgggtgcgcgacgccaccaccggccagcgcgtgcccgtgcgcacccgcccccctcgctcttag

SEQ ID NO: 477 - DNA, 1686 bp, Adenovirus B21; identical to SEQ ID NO: 167
  MISC_FEATURE (1)..(1686): B21.orf00045 L2 penton protein

SEQ ID NO: 478 - DNA, 1764 bp, Adenovirus B21
  MISC_FEATURE (1)..(1764): B21.orf00046 L1 protein IIIa
atggaacagcaggcaccggaccccgcaaaacgggcggcgctacagagccagccgtccggcattaactcctcggacgattggagccaggccatgcaacgcatcatggcgctgacgacccgcaaccccgaagcctttaggcagcaaccccaggccaaccgcctttctgctatcctggaggccgtagtgccctcccgctccaaccccacacacgagaaggtcctggccatcgtgaacgcgctggtggagaacaaagccatacgtcccgatgaggctgggctggtatacaatgccctattggagcgcgtagcccgctacaacagcagcaacgtgcagaccaacctggaccggatggtgaccgatgtgcgcgaggccgtgtctcagcgcgagcggttccagcgagacgccaatttagggtcgctggtggctttgaacgccttcctcagcactcagcctgccaacgtgcctcgcggtcagcaagactacacaaactttctaagtgcattgagactcatggtggccgaagtccctcaaagcgaagtgtaccagtccgggccagactactttttccagaccagcagacagggcttgcagacagtgaacctgagccaggcttttaagaacctgaatggtctgtggggagtgcgcgccccagtgggagatcgggcgaccgtgtctagcttgctgacccccaactcccgcctactactgctcttggtagccccattcactgacagcggtagcatcgaccgtaattcgtacttgggctatctgttgaacctgtatcgcgaggccatagggcaaactcaggtagatgagcaaacctatcaagaaattacccaagtgagccgcgctctgggtcgggaggacactggcagcttggaagccaccttaaacttcttgctgaccaaccggtcgcagaagatccctcctcagtatgcgcttaccgcggaggaggaacggatcctgagatacgtgcagcagagcgtgggactgttcctaatgcaggagggggcgactcctactgctgcgctcgatatgacagcccgaaacatggagcccagcatgtatgccagtaaccggccttttatcaataaactgctagactacttacacagggcggctgctatgaactctgattatttcaccaatgctatcctgaacccccattggctgcccccacctgggttctatacgggcgagtatgacatgcccgaccccaatgacgggtttttatgggacgatgtggacagtagtgttttctccccgcctcctggttataacacttggaagaaggaaggtggcgatagaaggcactcttccgtgtcactgtccggggcaacgggtgctgccgcagcggctcccgaggccgcaagtcctttccctagtttgccattttcgctaaacagtgtacgcagcagtgagctgggaagaataacccgtcctcgcttgatcggcgaggaggagtatttgaacgactccctgttgagacccgagagggagaagaatttccccaacaacgggatagaaagcttggttgacaaaatgaaccgctggaagacgtacgcgcacgatcacagggacgatccccgggcgctgggggatagccggggcagcgctacccgtaaacgccagtggcacgacaggcagcggggcctggtgtgggccgatgatgattccgccgacgacagcagcgtgttggacttgggtgggagtggtggtaacccgttcgctcacctgcgcccccgcgtcgggcgcctgatgtaa

SEQ ID NO: 479 - DNA, 1170 bp, Adenovirus B21
  MISC_FEATURE (1)..(479): B21.orf00047 L1 43 kDa protein
atgcatcccgtgctgcgacagatgcgcccccagcaacagcccccttctcagcagcagctacaacaacagccacaaaaggctcttcctgctcctgtaactactgcggctgcagccgtcagcggcgcggggcagcccgcctatgatctggacttggaagagggcgagggactggcgcgcctgggcgcaccatcgcccgagcggcacccgcgggtgcaactgaaaaaggactctcgcgaggcgtacgtgccccagcagaacctgttcagggacaggagcggcgaggagcctgaggaaatgcgagcttcccgctttaacgcgggtcgcgaactgcgtcacggtctggaccgaagacgggtgctgcgtgatgatgattttgaagtcgatgaagtgacaggaataagtcctgctagggcacatgtggccgcggccaacctagtatcagcttacgagcagaccgtgaaggaggagcgcaactttcaaaaatctttcaacaaccatgtgcgcaccctgattgcccgcgaggaagtgacactgggactgatgcacctgtgggacctgatggaagccattacccagaaccccaccagcaaacctctaaccgctcagctgtttctggtggtgcaacatagtagagacaatgaggcatttagggaggcgctgttgaacattactgagcccgaggggagatggttgtatgatcttatcaatattctgcaaagtataatagtgcaagaacgtagcctgggtctagctgagaaggtggctgctattaactactcggtcttgagcctgggcaagcactacgctcgcaagatctacaaaaccccatacgtacctatagacaaggaggtgaagatagatgggttttatatgcgcatgactctcaaggtgctgaccttgagtgacgatctgggagtgtaccgcaacgacaggatgcaccgcgcagtgagcgccagcagaaggcgtgagctgagcgacagagaacttatgcacagcttgcaaagagctctgactggggctggaaccgagggggagaactactttgacatgggagcggacttgcaatggcagcccagtcgcagggccctggacgcagcagggtatgagcttccttacatagaagaggtggatgaaggccaggatgaggagggcgagtacctggaagactga

SEQ ID NO: 480 - DNA, 1923 bp, Adenovirus B21
  MISC_FEATURE (1)..(1923): B21.orf00051 E2B terminal protein
atgaactacttcatgccgctgcgcaacatctggaaccgcgtacgcgagttcccgcgggcatccaccaccgcctccggtatcacctggatgtccaggtacatctacggttatcaccgcctcatgctggaagacctcgcccctggcgccccggctacagagcgatggcccctataccgccagccgccgccgcactttcttatcggctaccagtacctggtgcgcacctgtaacgattacatctttgacacccgcgcctactcgcgcctcaagtacaccgagattgtgcgtccggggcaccagacagtcaactggtcagtcatggccaactgctcctacacaatcaacaccggggcttaccaccgcttcgtggactttgacgacttccaagccaccctcacccaggtgcagcaagccatcctcgcagaaagggttgtagcggacctggcacttgtccagcccatgcgcgggttcgggatcactcgcatgcatggcagagcgggcgaagaagaagtgcccgtggaacgactcatgcaagactactataaagatctggccagatgtcaggataatgcttggggaatggcccatcgcctgcgcatccaacaagccggacccaaagacctggtgctcctcgccaccatccgccgtctcaaaactgcctattttaatttcatcaccagcagcatcgtctcaccctccaaagaggaggaaggagaagaaagagagaaccccgaccgagcgtctagccgcccccgcccgcaagaaacagtgctcagcctaccttgcgattgcgactggttagacgctttcgtcgaaaggttttcagatcccgtggatcttgagacgatcaggtccttgcgcggagtacctacggggcaattgataaaatgcataatcagcgcggtgtccctgcccaacggagagcctcccagtcaccacttcagggagatgcgcggaggcgtcttcactctgagacccagggagaacggtcgtgccgtcaccgagaccatgcgccgccgccgcggagaggtcattgaaagattcatcgaccgtctgcccgtgcgccgccggcgtcgccgcgttccccctcctcctgcagccccacctgaagaggaagagatgttagtggaagaagaagagattgaggaagaaatcccaggggctttcgagcgcgaggtgcgcaccaccgtcgccgaactcatccgtcttctggaagaggagttgaccgtgtccgcgcgtaactcccagtttttcaactttgccgtggacttctacgaggccatggagcgcttggaagcgctgggcgatgtcagcgagatgccgctgagacgatggatcatgtatttcttcgtcaccgagcacatcgccaccacactcaactaccttttccagcgtctatgcaactatgcggtcttcacccgccacgtggagctcaacctcgcccaggtggtcatgcgcgcgagagatcccgtgggggctgtggtctacagccgcgtctggaacgaggcgggcatgaatgcattctctcaactcattgggcgcatctccaacgacctggcggccaccgtcgagagagcgggccgcggagatcttcaagaggaagagatcgagcagttcatggccgagatcgcctaccaggacaactctggcgacgtgcaagaaatccttaggcaagccgccgtcaacgataccgagattgattctgttgaactctctttcaggttcaagctcacggggccggtagctttcacccagaggcgtcagatccaggatgtcaaccgccgcgtcgtcgcgcatgcgagtcttctcagagcacagtaccagaacctacccgcgcgcggcgccgacgtaccactgccagccatgccgccgggtcccgaaccgcccctgccgcccggtgcgcgccctcgacaccgcttctaa

SEQ ID NO: 481 - DNA, 3369 bp, Adenovirus B21
  MISC_FEATURE (1)..(3369): B21.orf00052 E2B DNA polymerase
atgcaagaagcaacagagccaccgccgcccaaaaggaaaaacaagggcacggtggtagcacccaaggggcacggaaccctgcaagccatcgacatctccaccaacggacccgtggagatcaagtaccatctgaacctccctcacgccctcgaaaagatcatgcaagtcaatctcctgacactgcctactaacctgactccgcagcgtctcaggaccctggacagctccggcctgcgcgctctcgtcctcgagctccgcccctgccgcgccgaggtctggacttgcctcccgcgagggctcgtcagcatgaccaccatcgagacagaagatggtcatgccgatgcagacaacatagtagagcgcgaggtacaaacgccaggcctcaattttccactgaaatttctcgtcaaaggaagtcaggtacaactcattcatgaggtgcatcccgtgaatcgctgcgagtactgcggccgtctgtacaagcacaagcatgaatgctcggcgcgtcgcagggagttctacttccatcacatcaacagccattcctccaactggtggcaggagatccagttcttcccgattggctctcatcctcgcacagaaaggctcttcctcacctacgatgtggaaacctacacctggatggggtcctttggcaagcagctaatccccttcatgctggtcatgaaactctctggagaccagcggctcgtcaacatcgcctatgacctcgccatgaaactcaagtgggatcgctggcggcaggacccccaaaccttctattgcgtcaccccagaaaagatggcagtcgggcagcattttcgtcagtaccgggaccagttacaaacagcactggcagtggacctctggtcctccttcctcaaagcgaaccctcacgtgcacgaatgggccctcgaacactatgctctcactgaccctacagatctcacttttgaagaactcaagaagctgcctcatgtcaggggcacccctcgattcttagaactgtacatagtggggcacaacatcaatggctttgatgagatcgtcttggccgctcaggttatcaataaccgagcagaggtccctcagcctttcaaaatcacccgaaatttcatgcccagggccggcaagatcctcttcaatgatgttactttcgctttgcccaaccccgcctacaagaagcgggtggacttccaactctgggaacagggggcctgtgatgacattgacttcaagtatcaattcctcaaagtcatggtcagggacacttttgccctcactcatacctcgctgcgcaatgcagcccaagcatactctcttccagtggagaagggatgctgtccctacaaggcagtcaatcagttctacatgttgggctcttaccgtgcagaaaaagacgggtttcccctcgaagagtactggaaggatcgcgaagaataccttctcaaccgcgagctgtgggaaaagaaaagccaaccgcgttatgacatcatccaggaaactctcgactactgtgccctggatgtactcgtcaccgccgagctggtagccaagctgcaagagtcatatgcccacttcataagggactctgtaggcctacctcatgcccattttaacatattccagagacctactatctcttccaattcccatgccatctttcgccagatcgtttacagggcggaaaaacccaaccgcaccaatctgggcccgggtcttctcgccccctcacatgaactctatgactatgtgcgagcaagcatcagaggggggcgctgttatcccacttacatcggcatcctcgaagagcccctctatgtctacgatatctgtggcatgtatgcctccgcgctcacccaccccatgccctggggcacccctcttaacccctatgagcgcgcgctggcagttcgagaatggcagatgaccttggatgatcccgccaccatcagctattttgacaaagatttgctaccgggaatatttaccatagatgcggacccccctgatgagttcatgctagaccccctcccacctttctgttcaagaaaaggaggtcgactctgctggaccaatgagcccctccgaggcgaggtggccaccagtgtggatctgataaccctgcacaataggggatggcgagtcagaatagttccggatgaactgacaaccatcttccctgaatggaaatgtgtggcgcgcgagtacgtccagcttaacatcgccgccaaggagcgcgcggacaaggaaaagaaccaaaccatgcgctccatcgccaagcttctgtccaatgccctttatggatcatttgccaccaagctggacaacaagaagattgtgttttctgaccagatggacgagagtcttatgaaaggcgtctctgctggtactgtcaatatcaaatcctcctcgttcctagaaactgacaacctgagtgcagaggtcatgcccgccttcgagagggaatacctaccccaacagctggcgctcctggacagcgatcctgaagacagtgaggacgaacagaggcccgcccccttttatacccccccggcggggacccctggtcacgtggcctacacttacaagccaatcacattcttggatgtggaggagggggacatgtgtttacataccgtagagaaggtggacccactggttgacaacgaccgctacccctcccacgtggcctcctttgtgctggcctggacacgcgcttttgtatcagagtgggctgggttcctctacgaagaggaccgaggcactccgctcgaggacaggcccataaagtcggtctacggggacacggacagcctctttgtcacccagcggggacacgaactcatggaaaccaaaggtaagaaacgcatcaaaaaacatggcggaaaacttgtttttgaccccgatgagccggatctgacctggctcgtggagtgcgaaaccgtctgcgcctcctgcggtgcggatgcatactcccccgaatccattttcctcgcgcccaagctgtatgccctcaaatgtatctactgccccgcctgccataaaacttccaaaggtaagctccgtgccaaaggccacgcggccgaggcgctcaactacgaactcatggtaaactgctacctggccgacctgcagggcgccgatcggcagcggttctcgaccagcaggatgagtctgaagcgcaccctcgcaagcgcccaaccaggcgcgcaccccttcaccgtgacggaaacaaccctgactcggacgctgcgaccatggaaggatcggaccctagcagcgctggacgcccatcgtctgattccctactccaggagccgtcccaacccgcgaaacgaggaggtctgttggatcgagatgccatag

SEQ ID NO: 482 - DNA, 1047 bp, Adenovirus B21
  MISC_FEATURE (1)..(1049): B21.orf00053 IVa2 protein IVa2
atgcccatggctgacgggctgaagccgctgaaaaacttctcctcgctccaggagcttctatcccttgggggagagcgcctcctaacggacttggtgcgggaaaatatccatgtaagggaaatgatgaacgaagtggcccccctgctccgggaggacggcagctgtcgctccctaaactaccatctgcaacccgtaattggggtcatttacggtcccactgggtgcggcaagtctcagctgcttaggaatttgctctcatcccagttaatcaccccggctccagaaacggtattttttatagccccgcaggtggacatgatccccccctcggaactgaaagcctgggaaatgcaaatatgtgagggaaactatgctcccgggccagagggaactttcatcccccaatctggcaccctccgcccaaagtttattaaaatggcttatgatgacctgactcaggagcataactatgatgtttcagacccccggaacgtgttcgcccgtgccgctgcccacggccccatcgctatcattatggatgagtgcatggagaatctggggggtcacaaaggcgtctccaaattttttcatgcttttccctctaagctgcatgataaatttcccaagtgcaccggatacactgtcttggtggttctgcacaatatgaatccgagacgggatctaggcggcaacattgccaacctcaagatccagtccaaaatgcatataatttcacccaggatgcacccgtcccagctcaacagatttgtaaacacctacactaagggcctccccgttgcaattagtctgctcctaaaagatattgtgcaacaccatgcactccgaccttgctatgactgggtgatttataacactaccccggagcaagaggctcttcaatggagctatctccacccccgagacggactaatgcccatgtatctaaacattcaatcccacctttacagggtactggaaaagatccaccgagttctcaatgatcgagaccgatggtccagggcataccgcgcgcgaaaaatcaaataa

SEQ ID NO: 483 - DNA, 417 bp, Adenovirus B21
  MISC_FEATURE (1)..(417): B21.orf00055 IX hexon associated protein IX
atgagtggaagcgcttcttttgaggggggagtatttagcccttatctgacgggcaggctcccatcatgggcaggagttcgtcagaatgtcatgggatccactgtggatgggagacccgtccagcccgccaattcctcaacgctgacctatgccactttgagttcgtcatcattggatgcagctgcagccgccgccgctactgctgccgccaacaccatccttggaatgggctattacggaagcatcgttgccaattccagttcctctaataacccttcaaccctggctgaggacaagctgcttgttctcttggctcagctcgaggccttaacccaacgcttaggcgaactgtctaagcaggtggcccagttgcgtgagcaaactgagtctgctgttgccacagcaaagtctaaataa

SEQ ID NO: 484 - DNA, 1479 bp, Adenovirus B21
  MISC_FEATURE (1)..(1479): B21.orf00056 E1B large T antigen
atggatccgccaaacccacttcagcaagggatacgttttggatttcatagcagcagctttgtggagaacatggaaggctcgcaggatgaggacaatcttagattactggccagtgcagcctctgggagtagcagggatactgagacacccaccggccatgccagcggttctggaggaggagcagcaggaggacaatccgagagccggcctggaccctccggtggaggagtagctgacctgtttcctgaactgcgacgggtgcttactaggtctacgtccagtggacaggacaggggcattaagagggagaggaatcctagtgggaataattcaagaaccgagttggctttaagtttaatgagccgtaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacagtatagaattactaagaagattaatattagaaatgcatgctacatatcagggaatggggcagaggttataatagatacccaagataaagcagcttttagatgttgtatgatgggtatgtggccaggggttgtcggcatggaagcagtaacatttatgaatattaggtttaaaggggatgggtataatggcattgtatttatggctaacactaagctgattctacatggttgtagcttttttgggtttaataatacttgtgtagaagcttgggggcaagttggtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcgaatgagaggccttatcagatgctgacctgcgctggtggacattgcaatattcttgctaccgtgcatatcgtttcccatgcacgcaagaaatggcctgtatttgaacataatgtgattaccaagtgcaccatgcacataggtggtcgcaggggaatgtttatgccttaccagtgtaacatgaatcatgtgaaggtgatgttggaaccagatgccttttccagagtgagcttaacaggaatctttgatatgaatattcaactatggaagatcctgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagttcggttctagtggtgaagaaactgactaa

SEQ ID NO: 485 - DNA, 174 bp, Artificial Sequence
  B21.orf00058 hypothetical protein
atggcagcaggttgctatgagctaaccacacagatctgctcctacttatatatccaagtccccacccaagaagcaataaaacactcagcagctgacataattttattacatgacgtcacattaaataaacacagctgcagggcactcattgtcttggcagtttccgggtactaa

SEQ ID NO: 486 - DNA, 243 bp, Adenovirus B21
  MISC_FEATURE (1)..(243): B21.orf00060 E1A 28.4 kDa protein
atggtagatttatgtttttacttgcgattttttgtaggtcctgtgtctgatgatgaggcgccttctcctgattcaactacctcacctcctgaaattcaggcgcccgtacctgcaaacgtatgcaagcccattcctgtgaagcctaagtgtgggaaacgccctgctgtggataagcttgaggacttgttggagggtggggatggacctttggaccttagtacccggaaactgccaagacaatga

SEQ ID NO: 487 - DNA, 594 bp, Adenovirus B21
  MISC_FEATURE (1)..(594): B21.orf00062 E1A 28.4 kDa protein
atgagacacctgcgattcctgccacaggagattatctccagcgagaccgggatcgaaatactggagtttgtggtaaataccctgatgggagatgacccggaaccgccagtgcagcctttcgatccacctacgctgcacgatctgtatgatttagaggtagacgggcctgatgatcccaatgaggaagctgtaaatgggttttttactgattctatgctgctagctgccgatgaaggattggacataaaccctcctcctgggacccttgataccccaggggtggttgtggaaagcggcagaggtgggaaaaaattgcctgatctgggagcagctgaaatggacttgcgttgttatgaagagggttttcctccgagtgatgatgaagatggggaaactgaacagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaa

SEQ ID NO: 488 - DNA, 378 bp, Adenovirus B50
  MISC_FEATURE (1)..(378): B50.orf00001 E4 ORF1 protein
atggctgatgaggctttgtatgtgtatttagatggaccgggggcgacgttgcctgaacagcagcagagaaataattatattttttattctcctgtgccttttactttgtatccgcgaggggtggctttgctatacttaagattaagcataattatacccagaggctatgttggctgttttttctctttaactgatgctaacatgtctggattatatgcttcatcaagaattattcatgctggccaccgcgaggaactttcggtgctgttgtttaatcacgatgacaggttttacgagggtcgagctggagaccctgtggcttgtcttgtgatggaaagactgatttatccacctgttcgacaggctactatgatatga

SEQ ID NO: 489 - DNA, 435 bp, Adenovirus B50
  MISC_FEATURE (1)..(435): B50.orf00002 E4 ORF2 protein
atgacgcttgtttcttttattttgcagactaattcaaaactaacaatgttggagcgcagcgcggtaacctattgcatttgcatcccagagattttgaatgtttctttggaaaatttttcttttattcaatttttacaagaaattctgcctgattatatttccagcaactttgatgatattactggtggttcccagtatgcttattctaatcttgtttttgctggagccaattggggaggtctgcgcttgtactgcactgtagcgtcccctgctattgttcccggggggcttttggctaagcagtttggtgataatatgagagagtatttacaactagaacttagagaagaacttagagccaagggcatgtcaattgatgatgccattcttaatttgctacaggtgacacaggagcaagatattttgtcattatga

SEQ ID NO: 490 - DNA, 336 bp, Adenovirus B50; identical to SEQ ID NO: 338
  MISC_FEATURE (1)..(336): B50.orf00003 E4 ORF3 protein

SEQ ID NO: 491 - DNA, 900 bp, Adenovirus B50
  MISC_FEATURE (1)..(900): B50.orf00008 E4 ORF6 protein
atgtcaggaaacaactccattatgacaaggttgcgcgcacgctcgacatcatgcgccagacatcacccttacaccagagcccagttaccacgatgtgaggaaaatgaaacccgagcttctatgactgaagaccacccgctgttgccagattgtgatactatgactatgcatagtgtaagttgtgttcgtggtcttccttgttctgccagctttactgttttgcaagagtttcccattccttgggatatgtttttaaatccagatgagttaaaaattatgagaagatgcatgcatttatgtctttgttgtgctactatagatatttttcagtctcaagtgattcatggtcgagagaattgggttcttcattgtcattgtaatcagcagggttcacttcaatgcatggctgggggagcggtgttggcagtgtggttccggaaggttatattgggttgcatgattaaccaacgttgtccatggtacagacagattgttaatatgcacatgccaaaagagatcatgtatgtgggtagtgtgtttttgagggaacgacatttaatttatattaaaatttggtatgatggtcatgcaggggcgattgtatcagatatgagttttggctggagcgcttttaattatggtttattaaacaatattgtgataatgtgctgtacatactgtagtaatctcagtgaaatcagaatgcgttgctgcgcgcatcgcaccagaaagttaatgttaagggctattaaaatcatgcttcaggacactgcagaccccgatcccataaacagcagtcgcacggagcgacgcagacagcggctgcttgtgggtttgatgagacacaatcgcccgattccgttttcggattatgattcccatcgttcttcttccagatga

SEQ ID NO: 492 - DNA, 252 bp, Adenovirus B50; identical to SEQ ID NO: 454
  MISC_FEATURE (1)..(252): B50.orf00009 E4 ORF6/7 protein

SEQ ID NO: 493 - DNA, 972 bp, Adenovirus B50; identical to SEQ ID NO: 136
  MISC_FEATURE (1)..(972): B50.orf00011 L5 fiber protein

SEQ ID NO: 494 - DNA, 165 bp, Adenovirus B50
  MISC_FEATURE (1)..(165): B50.orf00012 U protein
atgaagatcgtgggtacaggagaggagctaaaatttgacatcccctttaaagtatggagaaagtatgccgctgaacggggtttagaataccagagttgggaagagggaagcgaggtgctgctgggaaaaaatttcaacagagaccttattgctgatttcaagtaa

SEQ ID NO: 495 - DNA, 408 bp, Adenovirus B50
  MISC_FEATURE (1)..(408): B50.orf00015 E3 15 kDa protein
atgactgaaatactcaccacctccaattccgccgaggatctgcttgatatggacggccgcgcctcagaacagcgactcgcccaactacgcatccgccagcagcaggaacgcgtgaccaaagagctcagagatgtcatccaaattcaccaatgcaaaaaaggcatattttgtttggtaaaacaagccaagatatcctacgagatcaccgctactgaccatcgcctctcttacgaacttggcccccaacgacaaaaatttacatgcatggtgggaatcaaccctatagttatcacccagcaaagtggagatactaagggttgcattcactgctcttgcgattccaccgagtgcacctacaccctgctgaagaccctatgcggcctaagagacctgctacccatgaattaa

SEQ ID NO: 496 - DNA, 438 bp, Adenovirus B50
  MISC_FEATURE (1)..(438): B50.orf00017 E3 14.9 kDa protein
atgttgcggcacttcttaggcttatttaaaaccatgcaggctatgctaccagttattttaattctgctactaccctgcattgccctaccttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagagctagatgaacatatcccactacaacacatacaacaaccactagcattggtagagtatgaaaatgagccacaaccttcactgcctcctgctattagttacttcaacctaaccggcggagatgactga

SEQ ID NO: 497 - DNA, 276 bp, Adenovirus B50; identical to SEQ ID NO: 459
  MISC_FEATURE (1)..(276): B50.orf00019 E3 10.3 kDa protein

SEQ ID NO: 498 - DNA, 285 bp, Adenovirus B50
  MISC_FEATURE (1)..(285): B50.orf00021 E3 11 kDa protein
atgatattgtttcaatccaatgccactaacactatcaatgtgcagactactttaaaacatgacatggaaaaccacactacctcctatgcatacacaaatattcagcctaaatacgctatgcaactagaaatcaccatactaattgtaattggaattcttatactatctgttattctttattttatattctgccgtcaaatacccaatgttcatagaaattctaaaagacgtcccatctattctcctatgattagtcgtccccatatggctctgaatgaaatctaa

SEQ ID NO: 499 - DNA, 570 bp, Adenovirus B50; identical to SEQ ID NO: 461
  MISC_FEATURE (1)..(570): B50.orf00023 E3 20.8 kDa protein

SEQ ID NO: 500 - DNA, 540 bp, Adenovirus B50
  MISC_FEATURE (1)..(540): B50.orf00024 E3 20.1 kDa protein
atggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactgaaccaatatttgtaatctgtaacagacaaaatctcacgttaattaatgttagcaaaatttataacggttactattatggttatgatagatccagtagccaatataaaaattacttagttcgcataactcagcccaaatcaacagtgccaactatgacaataattaaaatggctaataaagcattagaaaattttacattaccaacaacgcccaatgaaaaaaacattccaaattcaatgattgcaattattgcggcggtggcattgggaatggcactaataataatatgcatgttcctatatgcttgttgctataaaaagtttcaacataaacaggatccactactaaattttaacatttaa

SEQ ID NO: 501 - DNA, 519 bp, Adenovirus B50
  MISC_FEATURE (1)..(519): B50.orf00025 E3 18.4 kDa protein
atgggggccatactagtcgtgcttgctttactttcgcttttgggtctgggctctgctaatctcaatcctcttgatcacaatccatgtctagacttcgacccagaaaattgcacacttacttttgcacccgacacaagccgtctctgtggagttcttattaagtgcggatgggactgcaggtccgttgaaattacacataataacaaaacatggaacaataccttatccaccacatgggagccaggagttcccgagtggtatactgtctctgtccgaggtcctgacggttccattcgcattagtaacaacactttcattttttctgaaatgtgcgatctggccatgtttatgagcaaacagtatgacctatggcctcctagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaa

SEQ ID NO: 502 - DNA, 321 bp, Adenovirus B50
  MISC_FEATURE (1)..(321): B50.orf00028 E3 11.7 kDa protein
atgtctaatggtggcgcggctgagctagctcgactgcgacacctagaccactgccgccgctttcgctgtttcgcccgggaactcaccgagttcatctacttcgaactctccgaggagcaccctcagggtccggcccacggagtgcggattaccatcgaagggggaatagactctcgcctgcatcgcatcttctcccagcggcccgtgctgattgagcgcgaccagggaaatacaaccatctccatctactgcatctgtaaccaccccggattgcatgaaagcctttgctgtcttgtttgtgctgagtttaataaaaactga

SEQ ID NO: 503 - DNA, 684 bp, Adenovirus B50
  MISC_FEATURE (1)..(684): B50.orf00029 L4 protein VIII
atgagtaaagagattcccacgccttacatgtggagctatcagccccaaatggggttggcagcaggtgcttcccaggactactccacccgcatgaattggcttagcgccgggccctcaatgatatcacgggttaatgatatacgagcttatcgaaaccagttactcctagaacagtcagctcttaccaccacaccccgccaacaccttaatccccgaaattggcccgccgccctggtgtaccaggaaaatcccgctcccaccaccgtactacttcctcgagacgcccaggccgaagttcagatgactaacgcaggtgtacagctggcgggcggttccgccctatgtcgtcaccggcctcaacagagtataaaacgcctggtgatcagaggccgaggtatccagctcaacgacgagtcggttagctcttcgcttggtctgcgaccagacggagtcttccagatcgccggctgtgggagatcttccttcactcctcgtcaggctgtgctgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattga

SEQ ID NO: 504 - DNA, 297 bp, Adenovirus B50
  MISC_FEATURE (1)..(297): B50.orf00030 L4 33 kDa protein
gtgaccagaaaagcagcagttagaaaatccacaacaagtgcagcaggaggaggactgaggatcacagcgaacgagccagcgcagaccagagagctgaggaaccggatctttccaaccctctatgccatcttccagcagagtcgggggcaagagcaggaattgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtag

SEQ ID NO: 505 - DNA, 129 bp, Adenovirus B50
  MISC_FEATURE (1)..(129): B50.orf00031 L4 22 kDa protein
gtgaacttcccccgcaatatcttgcattactaccgtcacctccacagcccctactgcagtcagcaagtcccggcaaccccgacagaaaaagacagcagcgacaacggtgaccagaaaagcagcagttag

SEQ ID NO: 506 - DNA, 2472 bp, Adenovirus B50
  MISC_FEATURE (1)..(2472): B50.orf00032 L4 100 kDa hexon-assembly associated protein
atggaaactcagccatcactgccaacatcgctgcaagcgccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaccaggaggctggcctcggggatcatgttgccgactacctctccgggcttgggagggaggacgtgctcctcaaacatctagcaaggcagtcgatcatagttaaagacgcactactcaacctcaccgaagtgcctatcagtgtggaagagcttagccgcgcctacgagctgaacctcttttcgcctcagataccccccaagcggcagcgaaacggcacctgcgaggccaaccctcgactcaacttctatccagcttttactgtccccgaagtgctggccacctaccacatcttttttaagaaccaaaagattccagtctcctgccgcgccaaccgcacccgcgcagatgcccttctcaacttgggtccgggagctcgcttacctgatatagcttccttggaagaggttccaaagatctttgagggtctgggaagtgatgagactcgggccgcaaatgctctgcaacagggagagaatggtatggatgaacatcacagcgctctagtggaactggagggtgacaatgcccggcttgcagtgctcaagcgcagtatcgtggtcacccattttgcctaccccgctgttaacctgccgcccaaagtcatgagcgctgtcatggaccatctgctcatcaaacgagcaagtccactttcagaaaaccagaacatgcaggatccagacgcctcggaggagggcaagccggtagtcagtgacgagcagctatctcgctggctgggtaccaactccccccgagatttggaagaaagacgcaagcttatgatggctgtagtgctagtaactgttgagttggagtgtctgcgccgcttttttaccgaccccgagaccctgcgcaagctagaggagaacctgcactacaccttcagacatggcttcgtgcgccaggcatgcaagatctccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaaccttaaagagctggacaagctcttgcagagatccctcaaagccctgtggacaggttttgacgagcgcaccgtcgcctcggacctggcggacatcatcttccccgagcgtcttagggttactctgcgaaacggcctgccagacttcatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctattccgcctggccaactacctctcctaccactcggatgtgatagaggatgtgagcggagacggcctgctggaatgccactgccgatgcaatttatgcacaccccaccgctccctcgcctgcaacccccagttgctaagcgagacccagatcatcggcaccttcgagttgcagggtcccaacagtgaaggcgaggggtcttctccggggcagagtctgaaactgacaccggggctgtggacctccgcctacctgcgcaagtttcatcccgaggactatcatccctatgagatcaggttctatgaggaccagtcacatcctcccaaagtcgagctctcagcctgcgtcatcacccagggggcaattctggcccaattgcaagccatccaaaaatcccgccaagaatttctgctgaaaaagggaagcggggtctaccttgacccccagaccggtgaggagctcaacacaaggttcccccaggatgtcccatcgccgaggaagcaagaagctgaaggtgcagctgtcacccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtag

SEQ ID NO: 507 - DNA, 1554 bp, Adenovirus B50
  MISC_FEATURE (1)..(1554): B50.orf00034 E2A DNA binding protein
atggccagccgcggaggaaatcagtcaagcgaccgccaacgggagcacacccccgaacgcggaatgggctctgccagccatccgcctccaaggccggaccgcagcccatctcagtcgcctccacctctgcccccgaagaggaacacctaccgtcgcgtggggtccgattcttctatcgagagccaggtggtactggtaagcgaaacttcgcggtcatccctgtctccggaacggagcaacagtcctcccccgatccctcccaagaagaagcccaggaagaccaagcatgtccctctgcaagacatcagccaggacagcgaagaagaaagagaacaggctcagttggtggccgtgggcttcagctaccccccggtgcgcatcattgagaaggatggcaagagaagtgttgagaagatcgacaagaatgaccctatagctaaaggagctacttctattgctgttaggaatcctttgagcttgcccctggtatctgcctgggagaagggcatggaagtgatggctgtgctaatggagaggtataggctggataatgacctgagaacctctttcaagctgatgccagagcagcacgagcagtacaagcgtatctgccaccagtatgtgaacgaggagcaccgtggcatcccgctgacatttagtagcatgaagaccctgacagcgatgatgggaagattcatgcagggattggtgcattcttattctgagatcgcccacaataattgggagtgcaccgggtgcgctctgtgggctcatggatgcaccgattacgaaggcaaggtgaaatgcctgcatggcactatcatgatccagaaggaccacattatcgagatggatgtggcgagcgaaaacgggcagcgcgctatgaaggagaacccagacagagccaagatcacccagaaccgctggggcagaaatgtggtccagttggccaacaacgatgcccgctgctgtgtgaatgatgccaactgtgctactaaccaattttccagcaagtcctgtgggatgttttacaccgagggaagtaaggctcaggaagctttcaagcagtacgaagccttcatgaaggccgtgtacccagggataacccccgaccaagccaggatgatgctgatccccattcattgcgattgcaaccacaagccaggctgcgctcccgtgatgggcaggcagacctgtaagatgaccccctttggaatggccaatgctgaagacttggatgtgactaccatcagtgacccgaccgtgctggcaagcgtgagacacccagccttgatggtgttccagtgttgcaacccagtgtaccgcaactcccgtgtccagaatgccggccccaactgtgatttcaagatctctgctcctgacctgcttggcgccctgcaactgaccagaaagttgtggcaagacacctttcccgaaattccagttcccaagctggtgatccccgagttcaagtggcagaacaggttacagttccgcaacgtctccctgcccacgggtcactctgactcccgccagaacccatttgatttctga

SEQ ID NO: 508 - DNA, 630 bp, Adenovirus B50
  MISC_FEATURE (1)..(630): B50.orf00036 L3 23 kDa protein
atgtcatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccgcgctcagccgcctgtggacttttttgctgtatgttccttcatgcctttgtgcactggcccgaccgccccatgaacggaaaccccaccatgaagttgctgactggggtgtcaaacagcatgctccaatcaccccaagtccagcccaccctgcgccgcaaccaggaggcgctatatcgcttcctaaacacccactcatcttactttcgttctcaccgcgcacgcattgaaagggccaccgcgtttgaccgtatggatatgcaataa

SEQ ID NO: 509 - DNA, 2787 bp, Adenovirus B50; identical to SEQ ID NO: 196
  MISC_FEATURE (1)..(2787): B50.orf00038 L3 hexon protein

SEQ ID NO: 510 - DNA, 141 bp, Adenovirus B50
  MISC_FEATURE (1)..(141): B50.orf00039 L3 hexon
atgtatgcccactggggcagcatcgatggggtggccatcttgaaatcaactcagcctcggcgcgcgacctcttccttgctcctctgctgttgctgcggcggcggcgtgatgatgacacatacacacagacaggcaagttaa

SEQ ID NO: 511 - DNA, 750 bp, Adenovirus B50
  MISC_FEATURE (1)..(750): B50.orf00041 L3 protein VI
atggaagacatcaatttttcatccctggctccgcgacacggcacgaggccgtacatgggcacctggagcgacatcggcaccagccaactgaacgggggcgccttcaattggagcagtatctggagcgggcttaaaaattttggctctaccataaaaacctatgggaacaaagcttggaacagcagcacagggcaggcattgaaaaataagcttaaagagcaaaacttccaacagaaggtggttgatggaatcgcctctggtatcaatggggtggtggatctggccaaccaggccgtgcagaaacagataaacagccgccttgacccgccgccgtcagcccctggtgaaatggaagtggaggaagatctccctccccttgaaaagcggggcgacaagcgtccgcgccccgatctggaggagacactagtcacacgctcagacgacccgccctcctacgaggaggcagtgaagcttggaatgcccaccaccagacctgtagcccccatggctaccggggtaatgaaaccttctcagtcacaccgacccgctaccttggacttgcctccccctgctgttgcagcgcctgctcgcaagcctgtcgctaccccgaagcccaccaccgtacagcccgtcgccgtagccagaccgcgtcctgggggcactccacgtccgaatgcaaactggcagagtactctgaacagcatcgtgggtctgggcgtgcaaagtgtaaagcgccgtcgctgcttttaa

SEQ ID NO: 512 - DNA, 231 bp, Adenovirus B50; identical to SEQ ID NO: 474
  MISC_FEATURE (1)..(231): B50.orf00042 L2 protein X

SEQ ID NO: 513 - DNA, 1062 bp, Adenovirus B50
  MISC_FEATURE (1)..(1062): B50.orf00043 L2 protein V
atgtccaagcgcaaatacaaggaagagatgctccaggtcatcgcgcctgaaatctacggtccgccggtgaaggatgaaaaaaagccccgcaaaatcaagcgggtcaaaaaggacaaaaaggaagaagatggcaatgatggtctggcggagtttgtacgcgagttcgccccaaggcggcgagtgcagtggcgtggacgcaaagtgcagcctgtgctgagacctggaaccacggtggtctttacgcccggcgagcgctccagcactgcttttaagcggtcctatgatgaggtgtatggggatgatgatattctggagcaggcggccgaccgcctgggcgagtttgcttatggcaagcgctcccgctcgagccccaaggaggaggcggtgtccattcccttggacaatgggaatcccacccctagtctcaagccagtcaccctgcagcaagtgctgcccgtgcctccacgcagaggcaacaagcgagagggtgaggatctgtatcccactatgcaattgatggtgcccaagcgccagcggctggaggacgtgctggagaaaatgaaagtggatcccgatatacaacctgaggtcaaagtgagacccatcaagcaggtggcgccaggtttgggagtacaaaccgtagacatcaagattcccaccgagtcaatggaagtccaaaccgaacctgcaaagcccacaaccacctccattgaggtgcaaacggatccctggatgaccgcacccgttacaactccagctgctgtcaacaccactcgaagatcccggcgaaagtacggtccagcaagtttgctgatgccaaattatgctctgcacccatccattattccaactccgggttaccgaggcactcgctactaccgcagcaggagcagcacttcccgccgtcgccgcaaaacacctgcaagtcgtagtcatcgtcgtcgccgccgccccaccagcaatctgactcccgctgctctggtgcggagagtgtatcgcgatggccgcgcggatcccctgacgttaccgcgcgtacgctaccatccaagcatcacaacttaa

SEQ ID NO: 514 - DNA, 579 bp, Adenovirus B50
  MISC_FEATURE (1)..(579): B50.orf00045 L2 protein VII
atgtccattcttatctcacctagtaataacaccggttggggcctgcgcgcgccaagcaagatgtacggaggtgctcgcaaacgctctacacagcaccctgtgcgcgtgcgcgggcacttccgcgctccatggggcgccctcaagggtcgtacccgcactagaaccaccgtcgatgatgtgatcgaccaggtggtggccgatgctcgtaattatactcctactgcacctacatctactgtggatgcagttattgacagcgtagtggctgacgcccgcgcctatgctcgccggaagagcaggcggagacgcatcgccaggcgccaccgggctactcccgctatgcgagcggcaagagctctgctgaggagggccaaacgcgtggggcgaagagctatgcttagagcggccagacgcgcggcttcaggtgccagtgccggcaggtcccgcaggcgcgcagccacggcggcagcagcggccattgccaacatggcccaaccgcgaagaggcaatgtgtactgggtgcgcgacgccaccaccggccagcgcgtgcccgtgcgcacccgcccccctcgctcttag

SEQ ID NO: 515 - DNA, 1686 bp, Adenovirus B50; identical to SEQ ID NO: 168
  MISC_FEATURE (1)..(1686): B50.orf00046 L2 penton protein

SEQ ID NO: 516 - DNA, 1761 bp, Adenovirus B50
  MISC_FEATURE (1)..(1761): B50.orf00047 L1 protein IIIa
atggaacagcaggcaccggaccccgcaaaacgggcggcgctacagagccagccgtccggcattaactcctcggacgattggagccaggccatgcaacgcatcatggcgctgacgacccgcaaccccgaagcctttagacagcaaccccaggccaaccgcctttctgccatcctggaggccgtagtgccctcccgctccaaccccacacacgagaaggtcctggccatcgtgaacgcgctggtggagaacaaagccatacgtcccgatgaggctgggctggtatacaatgccctattggagcgcgtagcccgttacaacagcagcaacgtgcagaccaacctggaccggatggtgaccgatgtgcgcgaggccgtgtctcagcgcgagcggttccagcgagacgccaatttagggtcgctggtggctttgaacgccttcctcagcactcagcctgccaacgtgcctcgcggtcagcaagactacacaaactttctaagtgcattgagactcatggtggccgaagtccctcaaagcgaagtgtaccagtccgggccagactactttttccagaccagcagacagggcttgcagacagtgaacctgagccaggcttttaagaacctgaatggtctgtggggagtgcgcgccccagtgggagatcgggcgaccgtgtctagcttgctgacccccaactcccgcctactactgctcttggtagccccattcactgacagcggtagcatcgaccgtaattcgtacttgggctatctgttgaacctgtatcgcgaggccatagggcaaactcaggtagatgagcaaacctatcaagaaattacccaagtgagccgcgctctgggtcgggaggacactggcagcttggaagccaccttaaacttcttgctgaccaaccggtcgcagaagatccctcctcagtattcgcttaccgcggaggaggaacggatcctgagatacgtgcagcagagcgtgggactgttcctaatgcaggagggggcgactcctactgctgcgctcgatatgacagcccgaaacatggagcccagcatgtatgccagtaaccggccttttatcaataaactgctagactacttacacagggcggctgctatgaactctgattatttcaccaatgctatcctgaacccccattggctgcccccacctgggttctatacgggcgagtatgacatgcccgaccccaatgacgggtttttatgggacgatgtggacagtagtgttttctccccgcctcctggttataacacttggaagaaggaaggtggcgatagaaggcactcttccgtgtcactgtccggagcaacgggtgctgcagcggctcccgaggccgcaagtcctttccctagtttgccattttcgctaaacagtgtacgcagcagtgagctgggaagaataacccgtcctcgcttgatcggcgaggaggagtatttgaacgactccctgttgagacccgagagggagaagaatttccccaacaacgggatagaaagcttggttgacaaaatgaaccgctggaagacgtacgcgcacgatcacagggacgatccccgggcgctgggggatagccggggcatcgctacccgtaaacgccagtggcacgacaggcagcggggcctggtgtgggccgatgatgattccgccgacgacagcagcgtgttggacttgggtgggagtggtggtaacccgttcgctcacctgcgcccccgcgtcgggcgcctgatgtaa

SEQ ID NO: 517 - DNA, 1170 bp, Adenovirus B50
  MISC_FEATURE (1)..(1170): B50.orf00048 L1 43 kDa protein
atgcatcccgtgctgcgacagatgcgcccccagcaacagcccccttctcagcagcagctacaacaacagccacaaaaggctcttcctgctcctgtaactactgcggctgcagccgtcagcggcgcggggcagcccgcctatgatctggacttggaagagggcgagggactggcgcgcctgggcgcaccatcgcccgagcggcacccgcgggtgcaactgaaaaaggactctcgcgaggcgtacgtgccccagcagaacctgttcagggacaggagcggcgaggagcctgaggaaatgcgagcttcccgctttaacgcgggtcgcgaactgcgtcacggtctggaccgaagacgggtgctgcgtgatgatgattttgaagtcgatgaagtgacaggaataagtcctgctagggcacatgtggccgcggccaacctagtatcagcttacgagcagaccgtgaaggaggagcgcaactttcaaaaatctttcaacaaccatgtgcgcaccctgattgcccgcgaggaagtgacactgggtctgatgcacctgtgggacctgatggaagccattacccagaaccccaccagcaaacctctaaccgctcagctgtttctggtggtgcaacatagtagagacaatgaggcatttagggaggcgctgttgaacattactgagcccgaggggagatggttgtatgatcttatcaatattctgcaaagtataatcgtgcaagaacgtagcctgggtctagctgagaaggtggctgctattaactactcggtcttgagcctgggcaagcactacgctcgcaagatctacaaaaccccatacgtacctatagacaaggaggtgaagatagatgggttttatatgcgcatgactctcaaggtgctgaccttgagtgacgatctgggagtgtaccgcaacgacaggatgcaccgcgcagtgagcgccagcagaaggcgtgagctgagcgacagagaacttatgcacagcttgcaaagagctctgactggggctggaaccgagggggaaaactactttgacatgggagcggacttgcagtggcagcccagtcgcagggccctggacgcagcagggtatgagcttccttacatagaagaggtggatgaaggccaggatgaggagggcgagtatctggaagactga

SEQ ID NO: 518 - DNA, 1923 bp, Adenovirus B50
  MISC_FEATURE (1)..(1923): B50.orf00052 E2B terminal protein
atgaactacttcatgccgctgcgcaacatctggaaccgcgtacgcgagttcccgcgggcatccaccaccgcctccggtatcacctggatgtccaggtacatctacggttatcaccgcctcatgctggaagacctcgcccctggcgccccggctacagagcgatggcccctataccgccagccgccgccgcactttctcatcggctaccagtacctggtgcgcacctgtaacgattacatctttgacacccgcgcatactcgcgccttaagtataccgagcttgtgcgccctgggcaccagacagtcaactggtcagtcatggccaactgctcctacacaatcaacaccggggcttaccaccgcttcgtggactttgacgacttccaagccaccctcacccaggtgcagcaagccatcctcgcagaaagggttgtagcggacctggcacttgtccagcccatgcgcgggttcgggatcactcgcatgcatggcagagcgggcgaagaagaagtgcccgtggaacgactcatgcaagactactataaagatctggccagatgtcaggataatgcttggggaatggcccatcgcctgcgcatccaacaagccggacccaaagacctggtgctcctcgccaccatccgccgtctcaaaactgcctattttaatttcatcaccagcagcatcgtctcaccctccaaagaggaggaaggagaagaaagagagaaccccgaccgagcgtctagccgcccccgcccgcaagaaacagtgctcagcctaccttgcgattgcgactggttagacgctttcgtcgaaaggttttcagatcccgtggatcttgagacgatcaggtccttgcgcggagtacctacggggcaattaataaaatgcataatcagcgcggtgtccctgcccaacggagagcctcccagtcaccacttcagggagatgcgcggaggcgtcttcactctgagacccagggagaacggtcgtgccgtcaccgagaccatgcgccgccgccgcggagaggtcattgaaagattcatcgaccgtctgcccgtgcgccgccggcgtcgccgcgttccccctcctcctgcagccccacctgaagaggaagagatgttagtggaagaagaagagattgaggaagaaatcccaggggctttcgagctcgaggtgcgcaccaccatcgccgaactcatccgtcttttggaagaagagttgaccgtgtccgcgcgtaactcccagtttttcaactttgccgtggacttctacgaggccatggagcgcttggaagcgctgggcgatgtcagcgagatgccgctgagacgatggatcatgtatttcttcgtcaccgagcacatcgccaccacactcaactaccttttccagcgcctatgcaactatgcggtcttcacccgccacgtggagctcaacctcgcccaggtggtcatgcgcgcgagagatcccgtgggggctgtggtctacagccgcgtctggaacgaggcgggcatgaatgcattctctcaactcattgggcgtatctccaacgacctcgcggccaccgtcgagagagcgggccgcggagatcttcaagaggaagagatcgagcagttcatggccgagatcgcctaccaggacaactctggcgacgtgcaagaaatccttaggcaagccgccgtcaacgataccgagattgattctgttgaactctctttcaggttcaagctcacggggccggtagctttcacccagaggcgtcagatccaggatgtcaaccgccgcgtcgtggcgcatgcgagtcttctgagggcgcagtaccagaacctacccgcgcgcggcgccgacgtaccactgccggccatgccgccgggtcccgaaccgcccctgccgcccggtgcgcgccctcgacaccgcttctaa

SEQ ID NO: 519 - DNA, 3369 bp, Adenovirus B50
  MISC_FEATURE (1)..(3369): B50.orf00053 E2B DNA polymerase
atgcaagaagcaacagagccaccgccgcccaaaaggaaaaacaagggcacggtggtagcgcccaaggggcacggaaccctgcaagccatcgacatctccaccaacggacccgtggagatcaagtaccatctgaacctccctcacgccctcgaaaagatcatgcaagtcaatctcctgacactgcctactaacctgactccgcagcgtctcaggaccctggacagctccggcctgcgcgctctcgtcctcgagctccgcccctgccgcgccgaggtctggacttgcctcccgcgagggctcgtcagcatgaccaccatcgagacagaagatggtcatgccgatgcagacaacatagtagagcgcgaggtacaatcgccaggcctcaattttccactgaaatttctcgtcaaaggaagtcaggtacaactcattcatgaggtgcatcccgtgaatcgatgcgagtactgcggccgtctgtacaagcacaagcatgaatgctcggcgcgtcgcagggagttctacttccatcacatcaacagccattcctccaactggtggcaggagatccagttcttcccgattggctctcatcctcgcacagaaaggctcttcctcacctacgatgtggaaacctacacctggatggggtcctttggcaagcagctaatccccttcatgctggtcatgaaactctctggagaccagcggctcgtcaacatcgcctatgacctggccataaaactcaagtgggatcgctggcggcaggacccccaaaccttctattgcgtcaccccagaaaagatggcagtcgggcagcattttcgtcagtaccgggaccagttacaaacagcactggcagtggacctctggtcctccttcctcaaagcgaaccctcacgtgcacgaatgggccctcgaacactatgctctcactgaccctacagacctcacttttgaagaactcaagaagctgcctcatgtcaggggcacccctcgattcttagaactgtacatagtggggcacaacatcaatggctttgatgagatcgtcttggccgctcaggttatcaataaccgagcagaggtccctcagcctttcagaatcacccgaaatttcatgcccagggccggcaagatcctcttcaatgatgttactttcgctttgcccaaccccgcctacaagaagcgggtggacttccaactctgggaacagggggcctgtgatgacatcgacttcaagtatcaattcctcaaagtcatggtcagggacacttttgccctcactcatacctcgctgcgcaatgcagcccaagcatactctctcccagtggagaagggatgctgtccctacaaggcagtcaatcagttctacatgttgggctcttaccgtgcagaaaaagacgggtttcccctcgaagagtactggaaggatcgcgaagaataccttctcaaccgcgagctgtgggaaaagaaaagccaaccgcgttatgacatcatccaggaaactctcgactactgtgccctggacgtactcgtcaccgccgagctggtagccaagctgcaagagtcatatgcccacttcataagggactctgtaggcctacctcatgcccattttaacatattccagagacctactatctcttccaattcccatgccatctttcgccagatcgtttacagggcggaaaaacccaaccgcaccaatctgggcccgggtcttctcgccccctcacatgaactctatgactatgtgcgagcaagcatcagaggggggcgctgttatcccacttacatcggcatcctcgaagagcccctctatgtctacgatatctgtggcatgtatgcctccgcgctcacccaccccatgccctggggcacccctcttaacccctacgagcgcgcgctggcagttcgagaatggcagatgaccttggatgatcccgccaccatcagctattttgacaaagatttgctaccgggaatatttaccatagatgcggacccccctgatgagttcatgctagaccccctcccccctttctgttcaagaaaaggaggtcgactctgctggaccaatgagcccctccgaggcgaggtagccaccagtgtggatctgataaccctgcacaataggggatggcgagtcagaatagttccggatgaactgacaaccatcttccctgaatggaaatgtgtggcgcgcgagtacgtccagcttaacatcgccgccaaggagcgcgcggacaaggaaaagaaccaaaccatgcgctccatcgccaagcttctatccaatgccctctatggatcatttgccaccaagctggataacaagaagattgtgttttctgaccagatggacgagagtcttatgaaaggcatctctgctggtactgtcaatatcaaatcctcctcgttcctagaaactgacaacctgagtgcagaggtcatgcccgccttcgagagagaatacctaccccaacagctggcgctcctggacagtgatccggaagacagtgaggacgaacagaggcccgcccacttttatacccccccggcggggacccctggtcacgtggcctacacttacaagccaatcacattcttggatgtggaggagggggacatgtgtttacataccgtagagaaggtggaccccctggttgacaacgaccgctacccctcccacgtggcctcctttgtgctggcctggacacgcgcttttgtatcagagtgggctgggttcctctacgaagaggaccgaggcactccgctcgaggacaggcccataaagtcggtctacggggacacggacagcctctttgtcacccagcggggacacgaactcatggaaaccaaaggtaagaaacgcatcaaaaaacatggcggaaaacttgtttttgaccccgatgagccggatctgacctggctcgtggagtgcgaaaccgtctgcgcctcctgcggtgcggatgcatactcccccgaatccattttcctcgcgcccaagctgtatgccctcaaatgtatctactgccccgcctgccataaaacttccaaaggtaagctccgtgccaaaggccacgcggccgaggcgctcaactacgaactcatggtaaactgctacctggccgacatgcagggcgccgatcggcagcggttctcgaccagcaggatgagtctgaagcgcaccctcgcaagcgcccaaccaggcgcgcaccccttcaccgtgacggaaacaaccctgactcggacgctgcgaccatggaaggatcggaccctagcagcgctggacgctcatcgtctgattccctactccaggagccgtcccaacccgcgaaacgaggaggtctgctggatcgagatgccatag

SEQ ID NO: 520 - DNA, 1041 bp, Adenovirus B50
  MISC_FEATURE (1)..(1041): B50.orf00054 IVa2 maturation protein IVa2
atggctgacgggctgaaaccgttgaaaaacttctcctcgctccaggagcttctatcccttgggggagagcgcctcctaacggacttggtgcgggaaaatatccatgtaagggaaatgatgaacgaagtggcccccctgctccgggaggacggcagctgtcgctccctaaactaccatctgcaacccgtaattggggtcatttacggtcccactgggtgcggcaagtctcagctgcttaggaatttgctctcatcccagttaatcaccccggctccagaaacggtattttttatagccccgcaggtggacatgatccccccctcggaactgaaagcctgggaaatgcaaatatgtgagggaaactatgctcccgggccagagggaactttcatcccccaatctggcaccctccgcccaaagtttattaaaatggcttatgatgacctgactcaggagcataactatgatgtttcagacccccggaacgtgttcgcccgtgccgctgcccacggccccatcgctatcattatggatgagtgcatggagaatctggggggtcacaaaggcgtctccaaattttttcatgcttttccctctaagctgcatgataaatttcccaagtgcaccggatacactgtcttggtggttctgcacaatatgaacccgagacgggatctaggcggcaacattgccaacctcaagatccagtccaaaatgcatataatttcccccaggatgcacccgtcccagctcaacagatttgtaaacacctacactaagggcctccccgttgcaattagtctgctcctaaaagatattgtgcaacaccatgcactccgaccttgctatgactgggtgatttataacactaccccggagcaagaggctcttcaatggagctatctccacccccgagacggactaatgcccatgtatctaaacattcaatcccacctttacagggtactggaaaagatccaccgagttctcaatgatcgagaccgatggtccagggcataccgcgcgcgaaaaaccaaataa

SEQ ID NO: 521 - DNA, 417 bp, Adenovirus B50
  MISC_FEATURE (1)..(417): B50.orf00056 IX hexon associated protein IX
atgagtggaagcgcttcttttgaggggggagtatttagcccttatctgacgggcaggctcccatcatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattacggaagcatcgttgccaattccagttcctctaataacccttcaaccctggctgaggacaagctacttgttctcttggctcagctcgaggccttaacccaacgcttaggcgaactgtctaagcaggtggcccagttgcgtgagcaaactgagtctgctgttgccacagcaaagtctaaataa

SEQ ID NO: 522 - DNA, 1221 bp, Adenovirus B50
  MISC_FEATURE (1)..(1221): B50.orf00057 E1B 54.9 kDa protein
gtgcttactaggtctacgtccagtggacaggacaggggcattaagagggaaaggaatcctagtgggaataattcaagaaccgagttggctttaagtttaatgagccgtaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacagtatagaattactaaaaagattaatattagaaatgcatgctacatatcagggaatggggcagaggttataatagatacccaagataaagcagcttttagatgttgtatgatgggtatgtggccaggggttgtcggcatggaagcagtaacatttatgaatattaggtttaaaggggatgggtataatggcattgtatttatggctaacactaagctgattctacatggttgtagcttttttgggtttaataatacttgtgtagaagcttgggggcaagttggtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcgaatgagaggccttatcagatgctgacttgcgctggtggacattgcaatattcttgctaccgtgcatatcgtttcccatgcacgcaagaaatggcctgtatttgaacataatgtgattaccaagtgcaccatgcacataggtggtcgcaggggaatgtttatgccttaccagtgtaacatgaatcatgtgaaggtgatgttggaaccagatgccttttccagagtgagcttaacaggaatctttgatatgaatattcaactatggaagatactgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagttcggttctagtggtgaagaaactgactaa

SEQ ID NO: 523 - DNA, 537 bp, Adenovirus B50
  MISC_FEATURE (1)..(537): B50.orf00058 E1B 20 kDa protein
atggaggtttgggctatcttggaagacctgagacagactaggctactgctagaaaacgcctcggacggagtctctggcttttggagattctggttcggtggtgatctagctaggctagtgtttaggataaaacaggactacagggaagaatttgaaaagttattggacgacagtccaggactttttgaagctcttaacttgggccatcaggctcattttaaggagaaggttttatcagttttagatttttctactcctggtagaactgctgctgctgtagcttttcttacttttatattggataaatggatccgacaaacccacttcagcaagggatacgttttggatttcatagcagcagctttgtggagaacatggaaggctcgcagcatgaggacaatcttagattactggccagtgcagcctctgggagtagcagggatactgagacacccaccgaccatgccagcggttctggaggaggagcagcaggaggacaatccgagagccggcctggaccctccggtggaggagtag

SEQ ID NO: 524 - DNA, 201 bp, Adenovirus B50
  MISC_FEATURE (1)..(201): B50.orf00059 E1A 6.5 kDa protein
gtgtctgatgatgagtcgccttctcctgattcaactacctcacctcctgaaattcaggcgcccgtacctgcaaacgtatgcaagcccattcctgtgaagcctaagtctgggaaacgccctgctgtggataagcttgaggacttgttggagggtggggatggacctttggaccttagtacccggaaactgccaaggcaatga

SEQ ID NO: 525 - DNA, 594 bp, Adenovirus B50
  MISC_FEATURE (1)..(594): B50.orf00060 E1A 29.1 kDa protein
atgagacacctgcgattcctgccacaggagattatctccagcgagaccgggatagaaatactggagtttgtggtaaataccctgatgggagatgacccggaaccgccagcgcagcctttcgatccacctacgctgcacgatctgtatgatttagaggtagacgggccggacgatcccaatgaggaagctgtaaatgggttttttactgattctatgctactagctgccgatgaaggattggacataaaccctcctcctgagacccttgataccccaggggtggttgtggaaagcggcagaggtgggataaaattgcctgatctgggagcagctgaaatggacttgcgttgttatgaagagggttttcctccgagtgatgatgaagatggggaaactgaacagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccattttatttacagtaagtgtatttaa

SEQ ID NO: 526 - DNA, 378 bp, Adenovirus B11
  MISC_FEATURE (1)..(378): B11.orf00001 E4 125 aa
atggctgatgaggctttgtatgtgtatttagagggaccgggggcgacgttgcctgaacagcagcagagaaataattatattttttattctcctgtgccttttactttgtatccgcgaggggtggctttgctatacttacgattaagcataattatacccaaaggctatgttggctgttttttctcgttaactgatgctaacatgtctggattgtatgcttcatcaagaattattcatgctggtcaccgcgaggaactttcggtgctgttgtttaatcatgatgacaggttttacgagggtcgagctggagaccctgtggcttgtcttgtgatggaaagactgatttatccatctgttcgtcaggctactatgatatga

SEQ ID NO: 527 - DNA, 390 bp, Adenovirus B11
  MISC_FEATURE (1)..(390): B11.orf00002 E4 130 aa
atgttggagcgcagcgcggtaacctattgcatttgcatcccagaggttttgaatgtttttttggcaaatttttcttttattcaatttttacaagaaactctgcctgattatatttccagcaacttcgatgatattactggcggttcccaatatgcttattccaatcttgtttttgctggagccaattggggaggtctgcgcttgtactgcactgtagcgtcccctgctcttgttcccggggggcttctggctaagcagtttggtgataatatgagagagtttttacaactagaacttaaagaagaacttagagccaagggcatgtcaattgatgttgccattctcaattcgctacaggtgacacaggagcaagatattttgtcattatga

SEQ ID NO: 528 - DNA, 354 bp, Adenovirus B11
  MISC_FEATURE (1)..(354): B11.orf00003 E4 117 aa
atgagggtgtgtttaagaatggtggtggagggcgccctccgggacctgtttgtaatgtgtggattggatttaccacaagaactgacacgaataattcaaggctggaaagctgaaaattatctgggaatggtgcaggaatgtaatatgatgattgaggagttagaaaatgctccttcttttggtattcttttgttcttggatgtgcgcgtggaggctttgctggaagccaccgttgagcaccttgaaaatcgcatttcttttgatctagctgtgctttttcaccaacacagtgggggcgagagatgccatctgcgcgatctacaatttgaagtactgcgagatcgtttggaataa

SEQ ID NO: 529 - DNA, 900 bp, Adenovirus B11
  MISC_FEATURE (1)..(900): B11.orf00006 E4 299 aa
atgtcaggaagcaactccattatgacaaggttgcgcgcacgctcgacatcatgcgccagacatcacccttacaccagagcccagttaccacgttgtgaggaaaatgaaacccgagcttctatgactgaagaccacccgctgttgccagattgtgatactatgactatgcatagtgtaagttgtgttcgtggtcttccttgttctgccagctttactgttctgcaagagcttcctattccctgggatatgtttctaaatcctgaggagttaaaaattatgagaagatgcatgcatttatgtctatgttgtgccactatagatatttttcattctcaagtgattcacggtcgagagaattgggttcttcattgtcattgtaatcagcagggttcacttcaatgcatggctgggggagcggtgttggcagtgtggttccggaaggttatattgggttgcatgattaaccaacgttgtccatggtacagacagattgttaatatgcacatgccaaaagagatcatgtatgtgggtagtgtgtttttgagggaacgtcatttaatttatattaaactttggtatgatggtcatgcaggggcgattatatcagatatgagttttggctggagcgcttttaattatggtttattaaacaatattgtaataatgtgttgtacctactgcaaagatttgagtgaaatcagaatgcgttgctgcgcgcatcgcaccagaaagttgatgttaagggctattaaaatcatgcttcaggacactgtggaccctgatcccataaacagcagtcgcacggagcgacgcagacagcggctgcttgtgggtttgatgagacacaatcgtccgataccgttttcggattatgattcccatcgttcttcttccagatga

SEQ ID NO: 530 - DNA, 252 bp, Adenovirus B11
  MISC_FEATURE (1)..(252): B11.orf00007 E4 ORF6/7 protein
atgaccgtgatccagactccggagtcgcatccgcagcagttggactgtgaaagcgctttaaaagactatcccgatggatttttatctatcactgaccccagattggctcgctctgaaactgtttggaatgtggaatctaaaaccatgtctatatctaatggtatccaaatgtttaaagctgtgcgtggggagagattggtgtattctgttaaatgggaagggggaggcaaaataactactcggattttgtga

SEQ ID NO: 531 - DNA, 978 bp, Adenovirus B11; identical to SEQ ID NO: 137
  MISC_FEATURE (1)..(978): B11.orf00008 L5 fiber

SEQ ID NO: 532 - DNA, 165 bp, Adenovirus B11
  MISC_FEATURE (1)..(165): B11.orf00009 U protein
atgaagattgtgggtacaggagaggagctaaaatttgacatcccctttaaagtatggagaaagtatgccgctgaacggggtttagaataccagagttgggaagagggaagtgaggtgctgctgggagaaaatttcaacagagaccttattgctgatttcaagtaa

SEQ ID NO: 533 - DNA, 408 bp, Adenovirus B11
  MISC_FEATURE (1)..(408): B11.orf00011 E3B 15.3K protein
atgactgaaacactcaccacctccaattccgccgaggatctgctcgatatggacggccgcgtctcagaacagcgactcgcccaactacgcatccgccagcagcaggaacgcgcggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaa

SEQ ID NO: 534 - DNA, 405 bp, Adenovirus B11
  MISC_FEATURE (1)..(405): B11.orf00012 E3 14.9 kDa protein
atgcaggctatactaccaatatttttgcttctattgcttccctacgctgtctcaaccccagctgcctatagtactccaccagaacaccttagaaaatgcaaattccaacaaccgtggtcatttcttgcttgctatcgagaaaaatcagaaattcccccaaatttaataatgattgctggaataattaatataatctgttgcaccataatttcatttttgatataccccctatttgattttggctggaatgctcccaatgcacatgatcatccacaagacccagaggaacacattcccctacaaaacatgcaacatccaatagcgctaatagattacgaaagtgaaccacaacccccactactccctgctattagttacttcaacctaaccggcggagatgactga

SEQ ID NO: 535 - DNA, 276 bp, Adenovirus B11
  MISC_FEATURE (1)..(276): B11.orf00013 E3B 10.3K protein
atggtacctagaaatttcttcttcaccatactcatttgtgcatttaatgtttgcgctactttcacagcagtagccacagcaaccccagactgtataggagcatttgcttcctatgcactttttgcttttgttacttgcatctgcgtatgtagcatagtctgcctggttattaattttttccaacttatagactggatccttgtgcgaattgcctacctgcgccaccatcccgaataccgcaaccaaaatatcgcggcacttcttagactcatctaa

SEQ ID NO: 536 - DNA, 564 bp, Adenovirus B11
  MISC_FEATURE (1)..(564): B11.orf00016 E3A 20.6K protein
atggtttccactaccacattccttatgcttactagtctcgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcattatcgctgcagtgacaattggaatatctattcttgtttttaccataacctactacgcctgctgctatagaaaagacaaacataaaggtgatccattacttagatttgatatttaa

SEQ ID NO: 537 - DNA, 546 bp, Adenovirus B11
  MISC_FEATURE (1)..(546): B11.orf00017 E3A 20.3K protein
atggcttctcttacatctctcatatttgtcagcattgtcactgccgctcatggacaaacagtcgtctctatccctctaggacataattacactctcataggacccccaatcacttcagaggtcatctggaccaaactgggaagcgttgattactttgatataatctgcaacaaaacaaaaccaataatagtaacttgcaacatacaaaatcttacattgattaatgttagcaaagtttacagcggttactattatggttatgacagatacagtagtcaatatagaaattacttggttcgtgttacccagttgaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaa

SEQ ID NO: 538 - DNA, 501 bp, Adenovirus B11
  MISC_FEATURE (1)..(501): B11.orf00018 E3A 18.5K protein
atggggcccatactagtcttgcttgttttactttcgcttttggaaccgggttctgccaattacgatccatgtctagacttcgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcctagcaaggacaacatcgtaacgttctccattgcttattgcttgtgcgcttgccttcttactgctttactgtgcgtatgcatacacctgcttgtaaccactcgcatcaaaaacgccaataacaaagaaaaaatgccttaa

SEQ ID NO: 539 - DNA, 396 bp, Adenovirus B11
  MISC_FEATURE (1)..(396): B11.orf00020 E3 14.6 kDa protein
atgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactag

SEQ ID NO: 540 - DNA, 318 bp, Adenovirus B11
  MISC_FEATURE (1)..(318): B11.orf00021 E3A 12.1K protein
atgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactga

SEQ ID NO: 541 - DNA, 684 bp, Adenovirus B11
  MISC_FEATURE (1)..(684): B11.orf00022 L4 protein VIII hexon associated protein
atgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattga

SEQ ID NO: 542 - DNA, 393 bp, Adenovirus B11
  MISC_FEATURE (1)..(393): B11.orf00023 L4 33K protein
atgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtag

SEQ ID NO: 543 - DNA, 2439 bp, Adenovirus B11
  MISC_FEATURE (1)..(2439): B11.orf00026 L4 100K protein
atggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtag

SEQ ID NO: 544 - DNA, 1557 bp, Adenovirus B11
  MISC_FEATURE (1)..(1557): B11.orf00027 E2A DNA binding protein
atggccagccgcgaaggaaatcagttaagcgaccgccacagggagcacacccccgaacgcggaaggggttctgccagtcatccgccttccaggtcggaccgcagcccttcgcaatcgcctccacctctgcccccgaagagaaacacctgtcgccgtgtggggtcaggttcttctaccgacagtcagttggtaatggtgagcgaaacgtcacaatcctccctgtctccggaacggagcgacagtcctcctcctccgataccccccaaaaagaagccaaggaagaccaaacatatccccatgcaagacatcagtcaagacagcgaagaagaaagagaagaggcgcaacttgtagcagtgggtttcagctacccgcccgtgcgcatcgttgagaaggatggcaaaagaagcattgagaagatcgctaaagatgaccctctggctaaaggagctgctgcctgcactgttaagaatccgattagcttgcccctggtgtctgcttgggagaaaggcatggaagtgatgtgtctgctgatggagaagtacaggctggataacgaacttagaacctcttttaaactaatgcctgagcaacacgaacaatacaagcgcatctgtcaccagtacgtaaacgaggagcaccgaggcatccagttaactttcactagtcacaagacactgagcacgatgatgggaagatttctgcagggaatgatacattctttttctcagatcgcccaccataattgggaatgtacaggctgtgcgttgtggcctcatggctgcaatgattatgagggcaagctgaagtgcctgcatggcaatattatgattcagaaggagcagattatcgagatggatgtggccagcgagaacggacaacgagccttaaaggagaatcccgagcgaaccaaaatcacccaaaaccgctggggcagaagtgtggtgcaaatagctaacaatgacgcccgctgctgtgtgaatgatgccggctgtgcagctaaccagttttcgagcaggtcctgcgggatgttttataccgagggtagtaaagcccagcaggctttcaagcaatatgatgctttcatgagagccgtgtatccaggaatcagacaggatcaggccaagatgatactgatccccctgcactgcgattgcaaccacaagcctaattgggtgcccgccatgggtaggcagacctgcaagatgaccccgttcagcattgccaatgctgaagatctggatgtgggcatgattgcagatcccaccgtgctggcaagcgtgagacatccgtcgctgatggtgtttcagtgctgcaatccggtgtaccgcaactctcgcgctcaaagcactggtcctaattgtgatttcaagatttcggctcctgacctgcttggagctttgcagctgaccagaaagctgtggagtgacatcctgcccgatataccggttcccaagttggtgattcccgaattcaagtggcaacccaagtatcagttccgcaacgtatcactgcctgcgggtcattctgattctcgtcagaacccattcgacttgtaa

SEQ ID NO: 545 - DNA, 630 bp, Adenovirus B11
  MISC_FEATURE (1)..(630): B11.orf00029 L3 23K proteinase
atggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataa

SEQ ID NO: 546 - DNA, 2847 bp, Adenovirus B11; identical to SEQ ID NO: 197
  MISC_FEATURE (1)..(2847): B11.orf00031 L3 hexon

SEQ ID NO: 547 - DNA, 741 bp, Adenovirus B11
  MISC_FEATURE (1)..(741): B11.orf00034 L3 protein VI
atggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaa

SEQ ID NO: 548 - DNA, 231 bp, Adenovirus B11
  MISC_FEATURE (1)..(231): B11.orf00035 L2 protein X
atggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattga

SEQ ID NO: 549 - DNA, 1056 bp, Adenovirus B11
  MISC_FEATURE (1)..(1056): B11.orf00036 L2 protein V
atgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaa

SEQ ID NO: 550 - DNA, 1698 bp, Adenovirus B11; identical to SEQ ID NO: 169
  MISC_FEATURE (1)..(1698): B11.orf00037 L2 penton

SEQ ID NO: 551 - DNA, 1593 bp, Adenovirus B11
  MISC_FEATURE (1)..(1593): B11.orf00040 L1 IIIa protein
atggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaa

SEQ ID NO: 552 - DNA, 177 bp, Artificial Sequence
  B11.orf00041 E2B 6.1 kDa hypothetical protein
atgatggccgatagacggttggcctggggttgctgtctaaaggcttcggggttgcgagtcgtcaacgccatgatacgttgcatggcctgggtccaatcgtccgaggagttaatgccggacggctggctctgcagcgccgcccgcattgcgggatccggtgcttgctgttccatctag

SEQ ID NO: 553 - DNA, 1167 bp, Adenovirus B11
  MISC_FEATURE (1)..(1167): B11.orf00042 L1 55K protein
atgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactga

SEQ ID NO: 554 - DNA, 1917 bp, Adenovirus B11
  MISC_FEATURE (1)..(1917): B11.orf00044 E2B terminal protein
atgaactacttcatgccgctacgcaacatttggaaccgcgtacgcgagtttcctcgggcttctactaccgccgcaggaatcacctggatgtccaggtacatctacggctatcaccgccttatgttggaagacctcgcccctggcgctccagctacagaacgatggcctctctaccgccaaccaccgccgcattttcttatagggtaccagtatctggtgcgcacctgcaacgattacatctttgacacccgcgcctattcgcgccttaaatacaccgagctcgtgcgccctggtcaccagacagttaactggtcagtcatggccaactgtgcttacaccattaatacaggagcttaccaccgctttgtggattttgatgactttcaagccacccttacccaagtacagcaagccatcctcgccgaaagagtcgtagctgacttggcactggtacaaccaatgcgcggatttggactcacacgtatgcatggcagaacgggtgaggaagaagtgcccgtagaacggctcatgcaagactactacaaagatcttgctagatgtcaggataatgcttggggaatggccaatcgcctgcgtatccagcaagccggacccaaagacctggtgctcctcgccaccatccgccgtcttagaactgcctactttaatttcatcaccagcagcatcgtctcaccttcccgagatgaagaagaaacagaagacccagaccgaacacataaccacccccgcccacaagaagccgtactcagcctaccttgtgactgtgactggttagacgctttcgtcgaaaggttttcagatcccgtggatcttgacacgatcagatctctgcgtgcagtccctacgggccaattaataaaatgtataatcagcgccctctccctcccaaacggagaacctcccagtcaccactttaaggagatgcgcggcggtgtttttactctgcgaccgcgcgagaacggccgcgccgtcactgaaaccatgcgccgccgccgcggagaggtcattgaacgattcatcgaccgtttgcccgtgcgccgtcgacgtcgccgcgtgccccctccgcccccgcctgaagacgaagaagagatgttagtggaagaagagatagaagaggaagaagagatcccgggagccttcgaacgcgaagtacgggccaccatagccgaactcatccgtcttctcgaggaggaattgaccgtgtccgcgcgaaactcccagttttttaattttgccgtggacttctacgaggccatggagcgcttggaagctctgggcgatgttagcgaaatgccgctgagacgatggatcatgtatttcttcgtcgccgaacacattgccaccacactcaactacctttttcagcgcctatgcaactatgcggtcttcaccagacacgtggagcttaacctcgctcaggtggtgatgcgcgcaagagactccgagggggccgtggtttacagccgcgtctggaacgaggcgggcatgaatgcattctcccaactcatgggccgtatctccaatgacctcgcggccaccgtcgaaagagcgggtcgcggagatcttcaggaggaagaaatcgagcagttcatggcggagatcgcctaccaggacaactctggtgacgtacaagaaatactgagacaagctgccgttaacgataccgaaattgattctgttgaactctctttcaggttcaagctcacggggccggtagctttcacccagagacgtcagatacaagacgtcaatcgacgcgtggtggcgcacgcaagtcttctcagagcgcagtaccagaacctgcccgtgcgcggcgccgacgtgccactaccagccatgccctcgggtccggaacaaccgctgccgcccggcgcgcgtccccgtcaccgcttctga

SEQ ID NO: 555 - DNA, 3369 bp, Adenovirus B11
  MISC_FEATURE (1)..(3369): B11.orf00045 E2B DNA polymerase
atgcaagaagcaagagagccaccaccgatcaaaagaaaaaacaaaggtacggtagtggcgcccaaaggacacggaaccctgcaagccattgacgtctctacaaacgaacctgtggaaatcaagtaccatctgaacctcccgcacgccctggaaaagatcatgcaagttaatcttctgtccctacctactaacctgagtccgcagcgtctcaggactctggacagctccagcctgcgcgctctcgtccttcagctccgcccctcccgcgccgaggtctggacttgcctcccgcgggggctcgtcagcatgaccaccatcgaaacagaagatgaacaggccgatacagcgaatatagaagagcacgagatacaatcgccaggcctcggcttcccactgaaatttctcgtcaagggaagccaggtacaactcattcacgagatacaacccgtgcaacgctgcgactactgcggccgtctgtacaagcacaaacacgaatgctcggcgcgccgcagaaacttctacttccatcacatcaacagccaatcctccaactggtggcaggaaatccagttcttcccgatcggctctcatcctcgcacagaaagactcttcctgacctacgatgtggaaacttacacctggatgggatcctttggcaaacaactagttcctttcatgctggtcatgaaactctcaggagaagagcgtctcgtcaacatggcccacgatctagccattaaactcaagtgggatcgatggcaacaagaccccagaaccttctactgtgtcactccagaaaaaatggcaattggccggcattttcgtcagtatcgggaccagttacaaacagcactggcggtagatctttggtcatcattcctacatgcaaatcctcacctgcacgaatgggctctcgaacactacgccttatctgaccccacagacctaacctttgatgagctcagtaagctacctcacgtcagaggcacgccgcgtttcatagaattatacatcgtaggacacaacatcaacggtttcgacgagatcgtcctagctgcccaggtgatcaacaatcgagcggaagtaccacagccttttcgcatcactcgcaattttatgcccagagccggtaagattctcttcaatgatgttactttcgctttgcccaaccccgcctacaagaaacgggtagacttccaactctgggaacagggagcctgtgacgacatcgacttcaaataccaatttctcaaagtcatggtcagagacacctttgcccttactcacgcttcgctacgaaaagctgctcaagcatactctctacccgtagagaagggctgctgcccttacaaggcagttaatcagttctacatgctaggatcttaccgtgcagacaaagacgggtttccgctagaagagtactggaaggatcgcgaagaataccttctcaaccgcgaactgtgggaaaagaaaaaccaaccaggttatgacatcattcaagaaacacttgactactgcgccctagacgtacttgtcaccgccgaactggtaaccaagcttcaagaatcttatgcccactttgtcagagactctgtaggtctacctcatgcccatttcaacatttttcaaagacccaccatctcttccaattctcacgccatctttcgccagatcgtctacagaacagaaaaacccaatcgcaccaacttgggtccggggctgctagcgccatcacatgaactatatgactatgtgcgagcaagtatcagaggggggcgatgctatccaacctacataggcatctttgaggatcccatctacgtctatgacatctgtggcatgtatgcctctgcactcacccatcccatgccatggggcagtccccttaacccatatgagcgcgcactggcagctcgagaatggcaaatggccttagatgaccccactcccatcagctattttgataaggatttacttccgggaatctttaccatggatgcagaccctcccgatgaacttatgctagacccacttccccctttctgttctaggaaaggaggtaggctctgttggaccaatgaaccccttcgaggcgaggtggccaccagtgtggatttaattaccttgcataatcgagggtggcaagtgagaatcgtgccagatgaattaacaactatcttccccgaatggaagtgcctggcacgcgagtatgtccaactcaacatcgccgccaaagagcgcgcggacaaggaaaagaaccaaaccatgcgatccattgccaaacttttatccaacgccctgtatggatcatttgccaccaaacttgacaataaaaaaattgtgttttctgaccaaatggacgaaaacctcatgaaaggcatctcaaccggcactgtcaatatcaaatcctcctcgttcttagaaactgacaacctgagtgcagaggtcatgcccgccttcgagagggaatacctaccccaacagctgacgttcctggacagcgatccggaagacagtgaggaagagcaaagaaccgcccccttttatacccccccagcggggaccccaggtcacgtgaaatacacctacaagccaatcacattcctggatgttgaagagggtgacatgtgtttgcatactttggaaaaggtggaccccctggttgacaacgatcgctacccctcccacatagcctcctttgtgctggcctggacgcgcgcctttgtatcagagtggtcagagttcctgtacgaagaagaccgaggcactccactggagaagaggcctgtaaaatcagtctacggggacacggacagcctgtttgtcactcaacgaggacacgaactcatggagaccaaaggtaagaaacgcatcaaaaaatatggcggaaaacttgtttttgaccccaatgaaccggatttaacctggctggtggaatgtgaaactgtttgcgcctcctgcggcgcagatgcatactccccagaatccgttttccttgcgcccaagttgtatgcgctgaaatgcctatactgcccggtatgcaagaaaacttccaaaggtaagctccgcgccaaaggccacgcagccgaggcgctcaactacgaactcatggtaaactgctacttggccgacatacagggcgccaagcgacagaagttttcgaccagcaggatgagtctgaagcgcaccctggcaagcgcccaagcaggcgcacaccccttcactgtgacggaaacaaccctgactcgaacactgagaccctggaaggaccgaaccctggcagcgctggacgcccatcgtctcataccctattccaggagccgtccaaacccgcgaaacgaggaggtctgctggatcgagatgccatag

SEQ ID NO: 556 - DNA, 1047 bp, Adenovirus B11
  MISC_FEATURE (1)..(1047): B11.orf00046 E2B protein IVa2
atgcccatggctgacggtctgaaaccgctgaaaaacttttcctcactacaagaacttctatcactaggaggagagcgcctcctaatggatttggtgcgggaaaatatgcatgtaagggaaatgatgaacgaggtggcccccttgcttcgagaagacggcagttgccgttccctaaactaccacctgcaacccgtaatcggaatcatttatggccccaccggatgtggcaaatctcaattgctcagaaatttgctatcatcacaattaatcacccccgccccagaaacggtgtttttcatagccccccaggtggacatgattccaccctcggaactgaaagcttgggaaatgcaaatctgtgaggggaactatgctccggggcccgaaggaacattcataccccaatctggtactctccgccccaaattcattaaaatggcttatgatgatttaactcaggaacataactatgatgtgtcagacccacggaacgtgtttgcccgcgccgctgcccacggccccattgctattatcatggatgagtgcatggaaaatcttggaggacacaagggtgtctccaaatttttccacgcttttccatccaagctgcacgataaatttcctaaatgtaccggatacaccgtcttggtggtccttcataacatgaacccaagacgggatcttggcggcaatattgccaacttaaaaatccaatccaaaatgcacataatttcaccccgaatgcacccatcccagctcaaccggtttgtaaacacctacaccaagggcttatctgtggcaatcagcctacttctaaaagatattgtgcaacaccatgcactgcgaccttgttatgactgggtgatttacaacactaccccggagcatgaatcccttcaatggagctatctccaccccaaagacggcctaatgcccatgtatctaaacattcaatcccacctctataggatcctggaaaaaatccaccgagttctcaatgatagagatcggtggtctagggcataccgtgcgcgaaaaatgaaataa

SEQ ID NO: 557 - DNA, 330 bp, Adenovirus B11
  MISC_FEATURE (1)..(330): B11.orf00047 E1B hexon associated protein IX
atgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataa

SEQ ID NO: 558 - DNA, 783 bp, Adenovirus B11
  MISC_FEATURE (1)..(783): B11.orf00052 E1B 55K protein
atgattcatgttacactggtaaggcataaacattcctctacgcccacctgcatgcatggtacacttcgtcatcacattgtgatcaaaaacaggccattttttgcgttgatgggaaacaatatgcacagtagccagcatattacaatgcccaccagcacaagtgagcatttgataaggcctctcatcggaagcaccgcaaatcatgttatgctttacgctggcatttcccttaatcaaaataaaacatccagtatctgtagaagcgcagtggcggacccttgcttcgccttcattcagaatgcccaggttacatctttgaaatatgcatttcttcagagacaattgactcttggttctgccagctgtggcaatccaacacgcatagaaactacatccccgtacactaacctgtccccaggcatctacacaggtattgttgaaaccaaaaaagctacaaccatgcaatataagtttggtattggccataaacactattccattataaccatctcccctaaacttaacatttacaaaagttactgcttccataccgactaccccaggccacatatccatcatgcagcatctaataactgccttgtcttgagtatctattaccacctcagccccatttccagatatgtaacaagcattccggatattaatccgtctagtaatcttatactgtttatcaggcctcaaagctatcttggcataatttttaatggccacctcccaatcatcctcaggctccaaccaacatgttttcacctgttccagtga

SEQ ID NO: 559 - DNA, 135 bp, Adenovirus B11
  MISC_FEATURE (1)..(135): B11.orf00053 E1B 55K protein
atgttttcacctgttccagtgaatatttctcctgcaatacagaaacttcatcccttccctctttctgaacctcatgccaccaaatggtttcaggacgtctgcgactcattaaacttaaagccaactcagatctag

SEQ ID NO: 560 - DNA, 261 bp, Adenovirus B11
  MISC_FEATURE (1)..(261): B11.orf00055 E1B 54.9 kDa protein
atgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaa

SEQ ID NO: 561 - DNA, 543 bp, Adenovirus B11
  MISC_FEATURE (1)..(543): B11.orf00056 E1B 21K protein
atggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtag

SEQ ID NO: 562 - DNA, 261 bp, Adenovirus B11
  MISC_FEATURE (1)..(261): B11.orf00058 E1A 231 R
atgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataa

SEQ ID NO: 563 - DNA, 840 bp, Adenovirus B11
  MISC_FEATURE (1)..(840): B11.orf00059 E1A 262 R
atgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaa

SEQ ID NO: 564 - DNA, 129 bp, Artificial Sequence
  B11.orf00060 hypothetical protein
atgcgtcacatttcccgcgacaacttgcaaaaaaactccacccccacaaaacgtcattttcccacggtcgcaccgccccttttagccgttaaccccacagccaatcaccacacgatccacactttttaa

SEQ ID NO: 565 - DNA, 177 bp, Artificial Sequence
  B14a.orf00002 hypothetical protein
atggggctaaagtacacaaaatcccgccaaacccaacacacaccccgaaactgcgtcaccacaaaagtacagtttcacttccgcaatcccaacaagcggcacttcctctttctcacgggacgtcacatccgcttaacttgcaacctcattttcccacggccgcgccgccccttttag

SEQ ID NO: 566 - DNA, 378 bp, Adenovirus B14a
  MISC_FEATURE (1)..(378): B14a.orf00003 E4 ORF1 protein
atggctgatgaggctttgtatgtgtatttagagggaccgggggcgacgttgcctgaacagcagcaaaggaataattatattttttattctcctgtgccttttactttgtatccgcgaggggtggctttgctatatttacgattaagcataattatacccagaggctatattggctgttttttgtctttaactgatgctaacatgtttggattgtatgcttcatcaagaattattcatgctggtcaccgcgaggaactttcggtgctgttgtttaatcacgatgacaggttttacgagggtcgggctggagaccctgtggcttgtcttgtgatggaaagactgatttatccacctgttcgtcaggctactctgatatga

SEQ ID NO: 567 - DNA, 429 bp, Adenovirus B14a
  MISC_FEATURE (1)..(429): B14a.orf00005 E4 ORF2 protein
ttgtttttttattttttgcagactcattcaaaactaacaatgttggagcgcagcgcggtaacttattgcatttgcatcccagaggttttgaatgtttttttggcaaatttttcttttattcaatttttacaacaaactctgcctgattatatttccagcaactttgatgacattactggtggttcccaatatgcttattccaatcttgtttttgctggagccaattggggaggtctgcgcttgtactgcactgtagcgtgtcctgctcttgttcccggggggcttctggctaagcagtttggtgataatatgaaagagtatttacaactagaacttagagaagaacttagagccaacggcatgtcaattgatgttgccattctcaatttgctacaggtgacacaggagcaagatattttgtcattatga

SEQ ID NO: 568 - DNA, 354 bp, Adenovirus B14a
  MISC_FEATURE (1)..(354): B14a.orf00006 E4 ORF3 protein
atgagggtgtgtttaagaatggtggtggagggcgccctccgggacctgtttgtaatgtgtggattggatttaccacaagaaatgacacgaataatccaaggctggaaagctgaaaattatctgggaatggtgcaggactgtaatatgatgattgaggagttagaaaatgctccttcttttggtattcttttgttcttggatgtgcgcgtggaggctttgctggaagccaccgttgagcaccttgaaaatcgcatttcttttgatctagctgtgctttttcaccaacacagtgggggcgacagatgccatctgcgcgatctacaatttgaagtactgcgagatcgtttggaataa

SEQ ID NO: 569 - DNA, 900 bp, Adenovirus B14a
  MISC_FEATURE (1)..(900): B14a.orf00009 E4 ORF6 protein
atgtcaggaagcaactccattatgacaaggttgtgcgcacgctcgacatcatgcgccagacatcatccttacaccagagcccagttaccacgttgtgaggaaaatgaaacccgagcttctatgactgaagaccacccgctgttgccagattgtgatactatgactatgcatagtgtaagttgtgttcgtggtcttccttgttctgccagctttactgttctgcaagagcttcctattccttgggatatgtttctaaatcctgaggagttaaaaattatgagaagatgcatgcatttatgtctatgttgtgctactatagatatttttcattctcaagtgattcacggtcgagagaattggattcttcattgtcattgtaatcagcagggttcacttcaatgcatggctgggggagcggtgttggcagtgtggttccggaaggttatattgggctgcatgattaaccaacgttgtccatggtacagacagattgttaatatgcacatgccaaaagagatcatgtatgtgggtagtgtgtttttgagggaacgtcatttaatttatattaaactttggtatgatggtcatgcaggggcgattatatcagatatgagttttggctggagtgcttttaattatggtttattaaacaatattgtgataatgtgctgtacctactgtattaatctaagtgaaataagaatgcgttgctgcgcgcatcgcaccagaaagttaatgttaagggctattaaaatcatgcttcaggacactgtggatcccgatcccataaacagcagtcgcacggagcgacgcagacagcggctgcttgtgggtttgatgagacacaatcgcccgatcccgttttcggattatgattcccatcgttcttcttccagatga

SEQ ID NO: 570 - DNA, 252 bp, Adenovirus B14a
  MISC_FEATURE (1)..(252): B14a.orf00010 E4 ORF6/7 protein
atgaccgtgatccagactccggagtcgcatccgcatcagttggactgtgaaagcgctttaaaagactatcccgatggatttttatctatcactgaccccagattggctcgctctgaaactgtttggaatgtggaatctaaaaccatgtctatctctaatggtatccaaatgtttaaagctgtgcgtggggagagattggtatattctgttaaatgggaagggggaggcaaaataactactcggagtttgtga

SEQ ID NO: 571 - DNA, 978 bp, Adenovirus B14a; identical to SEQ ID NO: 138
  MISC_FEATURE (1)..(978): B14a.orf00012 L5 fiber protein

SEQ ID NO: 572 - DNA, 165 bp, Adenovirus B14a
  MISC_FEATURE (1)..(165): B14a.orf00013 U protein
atgaagattgtgggtacaggagaggagctaaaatttgacatcccctttaaagtatggagaaagtatgccgctgaacggggtttagaataccagagttgggaagagggaagtgaggtgctgctgggagaaaatttcaatagagaccttattgctgattttaagtaa

SEQ ID NO: 573 - DNA, 441 bp, Adenovirus B14a
  MISC_FEATURE (1)..(441): B14a.orf00015 E3B 15.3K protein
ttgttttactttcgcttttgggaccgggttctgccaactacaacactcaccacctccaattccgccgaggatctgcttgatatggacggccgcgtctcagaacagcgactcgcccaactacgcatccgccagcagcaggaacgcgtggccaaagagctcagagatgtcatccaaattcaccaatgcaaaaaaggcatattctgtttggtaaaacaagccaaaatatcctacgagatcaccgctaccgaccatcgcctctcttacgagcttggcccccaacgacaaaaatttacctgcatggtgggaatcaaccccatagttatcacccaacaaagtggagatactaagggttgcattcactgctcctgcgattccatcgagtgcacctacaccctgctgaagaccctatgcggactaagagacctgctacccatgaattaa

SEQ ID NO: 574 - DNA, 396 bp, Adenovirus B14a
  MISC_FEATURE (1)..(396): B14a.orf00016 E3 14.6 kDa protein
atgaaagcctttgctgtcttatgtgtactgagtttaataaaaactgaattaagactctcctacggactgccgcttcttcaacccggattttacaaccagaagaacgaaacttttcctctcatccaggactctgttaactttacctttcctacttacaaaccagaagctcaacgacaacaccgcttttccagaagcattttccctactaatactactttcaaaaccggaggtgagctccacagtctccccgcagaaaacccttgggtggaagcgggccttgtagtgctaggaattcttgcgggcgggcttgtgattattctttgctacctatacacaccttgcttcactttcctagtggtgttgtggtattggtttaaaaaatggggcccatactag

SEQ ID NO: 575 - DNA, 318 bp, Adenovirus B14a
  MISC_FEATURE (1)..(318): B14a.orf00017 E3 11.7 kDa protein
atgtctggtgacgcggctgagctatctcggctgcgacatctagaccactgccgccgctttcgctgttttgcccgggaactcattgagttcatttacttcgaactccccaaggatcaccctcaaggtccggcccacggagtgcggattactatcgaaggtaaaataaactctcgcctgcatcgaattttctcccagcggcccgtgctgatcgagcgagaccagggaaacaccacggtttctatctactgcatttgtaatcacccaggattgcatgaaagcctttgctgtcttatgtgtactgagtttaataaaaactga

SEQ ID NO: 576 - DNA, 684 bp, Adenovirus B14a
  MISC_FEATURE (1)..(684): B14a.orf00018 L4 protein VIII
atgagtaaagaaattcccacgccttacatgtggagttatcagccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtataccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgattagaggccgaggtattcagcttaacgacgagtcggtgagctctccgcttggtctacgaccagacggaatctttcaaattgccggctgcgggagatcttccttcacccctcgtcagactgttttgactttggaaagttcgtcttcgcaaccccgctcgggcggaatcgggaccgttcaatttgtggaggagtttactccctctgtctacttcaaccctttctccggatctcctgggcactacccggacgagttcataccgaactttgacgcaattagcgagtcagtggacggctacgattga

SEQ ID NO: 577 - DNA, 393 bp, Adenovirus B14a
  MISC_FEATURE (1)..(393): B14a.orf00019 L4 33 kDa protein
atgttttgcattactaccgtcacctccacagcccctactatagccagcaaatcccggcaatctcgacagaaaaagacagcggcggcgacctccaacagaaaaccagcagcggcagttaaaaaatacacaacaagtgcagcaacaggaggattaaagattacagccaacgagccagcgcaaacccgagagctaagaaatcggatctttccaaccctgtatgccatcttccagcagagtcggggccaagagcaggaactgaaaataaaaaaccgatctttgcgttcgctcaccagaagttgtttgtatcacaagagcgaagatcaacttcagcgcactcttgaggacgccgaggctctcttcaacaagtactgcgcgctgactcttaaagagtag

SEQ ID NO: 578 - DNA, 2439 bp, Adenovirus B14a
  MISC_FEATURE (1)..(2439): B14a.orf00022 L4 100 kDa hexon-assembly associated protein
atggaaactcagccattgctgtcaacatcgccacaagtgccatcacatctcgtcgtcagcgacgaggaaaaggagcagagcttaaccattccaccgcccagtcctgccaccacctctaccctagaagataaggaggtcgacgcatctcatgacatgcagaataaaaaagcgaaagagtctgaaacagacatcgagcaagacccgggctatgtgacaccggtggaacacgaggaagagttgaaacgctttctagagagagaggatgaaaactgcccaaaacagcaagcggataactatcaccaagatgctggaaatagggatcagaacaccgactacctcatagggcttgacggggaagacgcgctccttaaacatctagcaagacagtcactcatagtcaaggatgcattattggacagaactgaagtgcccatcagtgtggaagagctcagccgcgcctacgagcttaaccttttttcacctcgtactccccccaaacgccagccaaacggcacctgcgagccaaatcctcgcttaaacttttatccagcttttgctgtgccagaagtactcgctacttatcacatcttttttaaaaatcaaaaaattccagtctcctgccgcgctaatcgcacccgcgctgacgccctacttaatctgggacctggttcacgcttacctgatatagcttccttggaagaggttccaaaaatcttcgagggtctgggcaataatgagactcgggccgcaaatgctctgcaaaagggagaaaatggcatggatgagcatcacagcgttctggtggaattggagggcgataatgccagactcgcagtactcaagcgaagcgtcgaggtcacacactttgcataccccgctgtcaacctgccccctaaagttatgacggcggtcatggaccagttactcattaagcgcgcaagtcccctttcagaagacatgcatgacccagacgcctgtgatgagggtaaaccagtggtcagtgatgagcagctaacccgatggctggacaccgactctccccgggatttggaagagcgtcgcaagcttatgatggccgtagtgctggttaccgtagaactagagtgtctccggcgtttctttaccgattcagaaaccttgcgcaaactcgaagagaatctgcactacacttttagacacggctttgtgcggcaggcgtgcaagatatctaacgtggaactcaccaacctggtttcctacatgggtattctgcatgagaatcgtctaggacaaagcgtgctgcacagcacccttaagggggaagcccgccgtgattacatccgcgattgtgtctatctctacctgtgccacacgtggcaaaccggcatgggtgtatggcagcaatgtttagaagaacagaacttgaaagagcttaacaagctcttacagaaatctcttaaggttctgtggacagggttcgacgagcgcaccgtcgcttccgacctggcagacctcatcttcccagagcgtcttagggttactttgcgaaacggactgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactacctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaactgcaaggccccagcagccaaggcgatgggtcttctcctgggcaaagtttaaaactgaccccgggactgtggacctctgcctacttgcgcaagtttgccccggaagattaccacccctatgaaatcaagttctatgaggaccaatcacagcctccaaaggccgaactttcggcctgcgtcatcacccagggggcaattctagcccaattgcaagccatccaaaaatcccgccaagaatttctactgaaaaagggtaagggggtctaccttgacccccagaccggcgaggaactcaacacaaggttccctcaggatgtcccaacgacgagaaagcaagaagttgaaggtgcagccgccgcccccagaagatatggaggaagattgggacagtcaggcagaggaagcggaggaggacagtctggaggacagtctggaggaagacagtttggaggaggaaaacgaggaggcagaggaggtggaagaagtaaccgccgacaaacagttatccccggctgcggagacaagcaacagcgctatcatctccgctccgagtcgaggaacgcggcggcgtcccagcagtag

SEQ ID NO: 579 - DNA, 1557 bp, Adenovirus B14a
  MISC_FEATURE (1)..(1557): B14a.orf00024 E2A DNA binding protein
atggccagccgcgaaggaaatcagttaagcgaccgccacagggagcacacccccgaacgcggaaggggttctgccagtcatccgccttccaggtcggaccgcagcccttcgcaatcgcctccacctctgcccccgaagagaaacacctgtcgccgtgtggggtcaggttcttctaccgacagtcagttggtaatggtgagcgaaacttcacaatcctccctgtctccggaacggagcgacagtcctcctcccccgataccccccaaaaagaagccaaggaagaccaaacatgttcccatgcaagacatcagtcaagacagcgaagaagaaagagaagaggcgcagcttgtagcagtaggtttcagctacccgcccgtgcgcatcgttgagaaggatggcaaaagaagcattgaaaagattgccaaagatgatcctctggctaaaggagctgctgcctgtactgttaagaatccgattagcttgcccctggtgtctgcttgggagaagggcatggaagtgatgtgtgtactgatggagaagtacaggctggataacgaacttagaacctcttttaaactaatgcctgagcagcacgaacaatacaagcgcatctgtcaccagtacgtaaacgaggagcaccgaggcatccagttaactttcactagtcacaagacactgagcacgatgatgggaagatttctgcagggaatgatacattctttttctcagatcgcccaccataattgggaatgtacaggctgtgcgttgtggcctcatggctgcaatgattatgagggcaagctgaagtgcctgcatggcactattatgattcagaaggagcagattatcgagatggatgtggccagcgagaatggacaacgagccttgaaggagaatcccgagcgaaccaaaatcacccaaaaccgctggggcagaagtgtggtgcaaatagccaacaatgacgcccgctgctgtgtgaatgatgccggctgcgcagctaaccagttttcgagcaggtcctgcgggatgttctataccgagggtagtaaagcccagcaggctttcaagcaatatgatgctttcatgagagccgtgtatccaggaatcagacaggatcaggccaagatgatactaatccccctgcactgcgattgcaaccacaagcctaattgggtgcccgccatgggtaggcagacctgcaagatgaccccgttcagcattgccaatgctgaagatctggatgtgggcatgattgcagatcccaccgtgctggcaagcgtgagacatccgtcgctgatggtgtttcagtgctgcaatccggtgtaccgcaactctcgcgctcagagcactggtcctaattgtgatttcaagatttcggctcctgacctgctgggagctttgcagctgaccagaaagctgtggagtgacatcctacccgatataccggttcccaagttggtgattcccgaattcaagtggcaacccaagtatcagttccgcaacgtatcactgcccgcgggtcattctgattctcgtcagaacccattcgacttgtaa

SEQ ID NO: 580 - DNA, 651 bp, Adenovirus B14a
  MISC_FEATURE (1)..(651): B14a.orf00025 L3 23K proteinase
ttgcaaacagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaacacggccggacgtgagacggggggagagcactggttggctttcggttggaacccacgttctaacacctgctacctttttgatccttttggattctcggatgatcgtcttaaacagatttaccagtttgaatatgagggtctcctgcgccgcagcgctcttgctaccaaggaccgctgtattacgctggaaaaatctacccagaccgtgcagggcccccgttctgccgcctgcggacttttctgctgcatgttccttcatgcctttgtgcactggcctgaccgtcccatggacggaaaccccaccatgaaattgctgactggagtgccaaacaacatgcttcattctcctaaagtccagcccaccctgtgtgacaatcaaaaagcactctaccattttctcaatacccattcgccttattttcgctcccatcgtacacacatcgaaagggccactgcgttcgaccgtatggatgtgcaataa

SEQ ID NO: 581 - DNA, 2838 bp, Adenovirus B14a; identical to SEQ ID NO: 198
  MISC_FEATURE (1)..(2838): B14a.orf00028 L3 hexon protein

SEQ ID NO: 582 - DNA, 741 bp, Adenovirus B14a
  MISC_FEATURE (1)..(741): B14a.orf00031 L3 protein VI
atggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaactttcaacaaaaagtagtcgatgggatagcttccggcatcaatggagtggtagatttggctaatcaggctgtgcagaaaaagataaacagtcgtttggacccgccgccagcaaccccaggtgaaatacaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagcccctatggctaccggggtaatgaaaccttctcagttgcatcgacccgtcactttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaa

SEQ ID NO: 583 - DNA, 231 bp, Adenovirus B14a
  MISC_FEATURE (1)..(231): B14a.orf00033 L2 protein X
atggccctcacttgtcgccttcgcgttcccatcactggttaccgaggaagaaattcgcgccgtagaagagggatgttggggcgcggaatgcgacgctacaggcgacggcgtgctatccgcaagcaattgcggggtggttttttgccagccttaattccaattatcgctgctgcaattggcgcgataccaggcatagcttccgtggcggttcaggcctcgcaacgacattga

SEQ ID NO: 584 - DNA, 1056 bp, Adenovirus B14a
  MISC_FEATURE (1)..(1056): B14a.orf00034 L2 protein V
atgtccaagcgcaaatacaaggaagaaatgctgcaggttatcgcacctgaagtctacggccaaccgctgaaggatgaaaaaaaaccccgcaaaatcaagcgggctaaaaaggacaaaaaagaagaggaagatggcgatgatgggctggcggagtttgtgcgcgagtttgccccacggcgacgcgtgcaatggcgtggacgcaaagttcgacatttgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataaatcccaaggatgagacagtgtccatacccttggatcatggaaatcccacccctagtcttaaaccggtcactttgcagcaagtgttacccgtaactccgcgaacaggtgttaaacgcgaaggtgaagatttgtatcccactatgcaactaatggtacccaaacgccaaaagttggaggacgttttggagaaagtaaaagtggatccagatattcaacctgaggttaaagtgagacccattaagcaggtagcgcctggtctgggagtacaaactgtagacattaagattcccactgaaagtatggaagtgcaaactgaacccgcaaagcctactgccacctccactgaagtgcaaacggatccatggatgccgatgcctattacaactgacgccgccggtcccactcgaagatcccgacgaaagtacggtccagcaagtctgttgatgcccaactatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatagtagtgcggaacctttgacactgccgcgtgcgcgttaccatccaagtatcatcacttaa

SEQ ID NO: 585 - DNA, 579 bp, Adenovirus B14a
  MISC_FEATURE (1)..(579): B14a.orf00035 L2 protein VII
atgtccattcttatctcgcccagtaataacaccggttggggtctgcgcgctccaagcaagatgtacggaggcgcacgcaaacgttctacccaacatcccgtgcgtgttcgcggtcattttcgcgctccatggggtgccctcaagggccgcactcgcgttcgaaccaccgtcgatgatgtaatcgatgaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtgggacgaagagccatgcttagggcggccagacgtgcagcttcgggcgccagcgccggcaggtcccgcaggcaagcagccgctgtcgcagcggcgactattgccgacatggcccaaacgcgaagaggcaatgtatactgggtgcgtgacgctgccaccggtcaacgtgtacccgtgcgcacccgtccccctcgcacttag

SEQ ID NO: 586 - DNA, 1608 bp, Adenovirus B14a; identical to SEQ ID NO: 170
  MISC_FEATURE (1)..(1608): B14a.orf00036 L2 penton protein

SEQ ID NO: 587 - DNA, 1764 bp, Adenovirus B14a
  MISC_FEATURE (1)..(1764): B14a.orf00040 L1 protein IIIa
atggaacagcaagcaccggatcccgcaacgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccattgtaaacgcgttggtggagaacaaagctattcgtccagatgaggccggactggtatacaacgctcttttagaacgcgtggctcgctacaacagtagcaatgtgcaaaccaatttggaccgtatgataacagatgtacgcgaagccgtgtctcagcgtgaaaggttccagcgcgatgccaaccttggttcgctggtggcgttaaatgcttttttgagtactcagcctgctaatgtgccgcgtggtcaacaggattatactaactttttgagtgcgttgagactgatggtatctgaagtacctcagagcgaagtgtatcagtccggacctgactacttctttcagactagcagacagggtttgcagacggtaaatctgagccaagcttttaaaaaccttaaaggtttgtggggagtgcatgccccggtaggagaaagagcaaccgtgtctagcttgttaactccaaactcccgcctattactactgttggtagctcctttcaccgacagcggcagcatcgaccgtaattcctatttgggttacctactaaacctgtatcgcgaagccatagggcaaagccaggtggacgagcagacctatcaagaaattacccaagtcagtcgcgctttgggtcaggaagacactggcagtttggaagccactctgaacttcttgcttaccaatcggtctcagaagatccctcctcaatatgctcttactgcggaggaggagaggatccttagatatgtgcagcagagcgtgggattgtttctgatgcaagagggggcaactccgactgcggcattggacatgacagcgcgaaatatggagcccagcatgtatgccagtaaccggcctttcattaacaaactgctggactacttgcacagagctgccgctatgaactctgattattttaccaatgccatcctaaacccgcactggctgcccccacctggtttctacacgggcgaatatgacatgcccgaccctaatgacgggtttctgtgggacgacgtggacagtaatgttttttcacctctttttgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggaatacctaaacgattccttgctcagaccggcgagagaaaaaaatttcccaaacaatggaatagaaagtttggtggataagatgagtagatggaagacttatgctcaggatcacagagacgagcctgggatcatggggactacaagtagagcgagccgtagacgccagcgtcatgacagacagaggggtcttgtgtgggaagatgaggattcggccgatgatagcagcgtgttggacttgggtgggagaggaaggggcaacccgtttgctcatttgcgccctcgcttgggtggtatgttgtaa

SEQ ID NO: 588 - DNA, 1161 bp, Adenovirus B14a
  MISC_FEATURE (1)..(1161): B14a.orf00042 L1 43 kDa protein
atgcatcccgtgctgcgacagatgcgtccccaacaacagcccccctcgcagcagcagcaaccacaaaaggctgtccctgcaactactgcaactgccgccgtgagcggtgcgggacagcccgcctatgatctggacttggaagagggcgaaggactggcacgtctaggtgcgccctcgcccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaagtgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttactcttggtttgatgcatttgtgggatttgatggaagctatcattcagaaccctactagcaaacctctgaccgcacagctgtttctggtggtgcaacacagcagagacaacgaggctttcagagaggcactgctcaacatcactgaacccgaggggagatggttgtatgatcttatcaacattctacagagtatcatagtgcaggagcggagcctgggcctggccgaaaaggtggctgccatcaattactcggttttaagtttgggaaaatattacgctcgcaagatctacaagactccatacgttcccatagacaaggaggtgaagatagatgggttctacatgcgtatgacgctcaaggtcttgaccctgagcgatgatcttggggtgtaccgcaatgacagaatgcatcgcgccgttagcgccagtaggaggcgcgagttaagcgacagggaactgatgcacagtttgcaaagagctctgactggagctggaacagagggtgagaattactttgacatgggagctgacttgcagtggcagcctagtcgcagggctctgagcgccgcgacggcaggatgtgagcttccttacatagaagaggcggatgaaggcgaggaggaagagggcgagtacttggaagactga

SEQ ID NO: 589 - DNA, 1917 bp, Adenovirus B14a
  MISC_FEATURE (1)..(1917): B14a.orf00043 E2B terminal protein
atgaactacttcatgccgctacgcaacatttggaaccgcgtacgcgagtttcctcgggcttccactaccgccgcaggaatcacctggatgtccaggtacatctacggctatcaccgccttatgttggaagacctcgcccccggcgctccagctacagaacaatggcctctctaccgccaaccaccaccgcattttcttatagggtaccagtatctggtgcgcacctgcaacgattacatttttgacacccgcgcctattcgcgccttaaatacaccgagctcgtgcgccatggtcaccaaacagttaactggtcagtcatggccaactgtgcttacaccatcaataccggggcttaccaccgcttcgtggattttgatgactttcaagccaccctcacccaagtacagcaagccatcctcgccgaaagagttgtagctgacttggcactggtccaaccaatgcgcgggtttggactcacacgtatgcatggcagaacgggtgaagaagaagtgcccgtagaacggctcatgcaagactactacaaagatctggctagatgtcaggataatgcttggggaatggccaatcgcctgcgtatccagcaagccggacccaaagacctggtgctcctcgccaccatccgccgtcttagaactgcctactttaatttcatcaccagcagcatcgtctcaccttcccgagatgaagaaggaatagaagacccagaccgaacacataaccacccccgcccacaagaagccgtactcagcctaccttgtgactgtgactggttagacgctttcgttgaaaggttttcagatcccgtggatcttgacacgattagatctctgcgcgcagtccctacgggccaattaataaaatgtataatcagcgccctttccctcccaaacggagaacctcccagtcaccactttaaggagatgcgcggcggtgtttttactctgcgaccgcgcgagaacggccgcgccgtcactgaaaccatgcgccgccgccgcggagaggtcattgaacgattcatcgaccgtttgcccgtgcgccgtcgacgtcgccgcgtgccccctccgcccccgcctgaagacgaagaagagatgttagtggaagaagagatagaagaggaagaagagatgccgggagccttcgaacgcgaagtacgggccaccatagccgaactcatccgtcttctcgaggaggaattgaccgtgtccgcgcgaaactcccagttttttaattttgccgtggacttctacgaggccatggagcgcttggaagctctgggcgatgtcagcgaaatgccgctgagacgatggatcatgtatttctttgtcgccgaacacatcgccaccacactcaactacctttttcagcgcctatgcaactatgcggtcttcaccagacacgtggagcttaacctcgctcaggtggtgatgcgcgcaagagactccgagggggccgtggtttacagccgcgtctggaacgaggcgggcatgaatgcattctcccaactcatgggccgtatctccaatgacctcgcggccaccgtcgagagagcgggtcgcggagatcttcaggaggaagaaatcgagcagttcatggcggagatcgcctaccaggacaactctggtgacgtacaagaaatactgagacaagctgccgttaacgataccgaaattgattctgttgaactctctttcaggttcaagctcacggggccggtagctttcacccaaagacgtcagatacaagacgtcaatcgacgcgtggtggcgcacgcaagtcttctcagagcgcagtaccagaacctgcccgtgcgcggcgccgacgtgccactaccagccatgcccccgggtccggaacaaccgctgccgcccggcgcgcgtccccgtcaccgcttttaa

SEQ ID NO: 590 - DNA, 3369 bp, Adenovirus B14a
  MISC_FEATURE (1)..(3369): B14a.orf00044 E2B DNA polymerase
atgcaagaagcaagagagccaccaccgatcaaaagaaaaaacaaaggtacggtagtggcacccaaaggacacggaaccctgcaagccattgacgtctctacaaacgaacctgtggaaatcaagtaccatctaaacctcccgcacgccctggaaaagatcatgcaagttaatcttctgtccctacctactaacctgagtccgcagcgtctcaggactctggacagctccagcctgcgcgctctcgtccttcagctccgcccctcccgcgccgaggtctggacttgcctcccgcgggggctcgtcagcatgaccaccatcgaaacagaagatgaacaggccaatacagcgaatatagaagagcacgagatacaatcgccaggcctcggcttcccactgaaatttctcgtcaagggaagccaggtacagctcattcacgagatacaacccgtgcaacgctgcgactactgcggccgtctgtacaagcacaaacacgaatgctcggcgcgccgcagaaacttctacttccatcacatcaacagccaatcctccaactggtggcaggaaatccagtttttcccaatcggctctcatcctcgcacagaaagactcttcctgacctacgatgtggaaacttacacctggatggggtcctttggcaaacaactagttcctttcatgctggtcatgaaactctcaggagaagagcgtctcgtcaacatggcccacgatctagccattaaacttaagtgggatcgatggcaacaagatcccggaaccttctactgtgtcactccagaaaaaatggcaattggccagcattttcgtcagtatcgggaccagttacaaacagcactggcggtggatctttggtcatcattcctacatgcaaatcctcatctgcacgaatgggcccttgaacactacgccttatctgaccctacagacctaacctttgatgagctcaataagctacctcacgtcagaggcacgccgcgtttcatagaattatacattgtaggacacaacatcaacggcttcgacgagatcgtcctagctgcccaggtgatcaacaatcgagcggaagtaccacagccttttcgcatcactcgcaattttatgcccagagccggtaagattctcttcaacgatgttactttcgctttgcccaaccccgcctacaagaaacgggtagacttccaactctgggaacagggagcctgtgacgacatggactttaaataccaatttctcaaagtcatggttagagacaccttcgcccttactcacgcttcgctacgaaaagctgctcaagcatactctctacccgtagagaagggctgctgcccttacaaggcagttaatcagttctacatgctaggatcttaccgtgcagacaaagacgggtttccgctagaagagtactggaaggatcgcgaagaataccttctcaaccgcgaactgtgggaaaagaaaaaccaaccaggttatgacatcattcaagaaacacttgactactgcgccctggacgtacttgtcaccgcccaactggtaaccaagcttgaagaatcttatgcccactttatcagagactctgtaggtctacctcatgcccacttcaacatttttcaaagacccaccatctcttccaattctcacgccatctttcgccagattgtctacagaacagaaaaacccaatcgcaccaacttgggtccggggctgctagcgccgtcacatgaactatatgactatgtgcgagcaagtatcagaggggggcgatgctatccaacctacataggcatctttgaggatcccatctacgtctatgacatctgtggcatgtatgcctctgcactcacccatcccatgccctggggcagtccccttaacccatatgagcgcgcactggcagctcgagaatggcaaatggccttagatgaccccactcccatcagctattttgataaggatttacttcctggaatctttaccatggatgcagaccctcccgatgaacttatgctagacccacttccacctttctgttctaggaaaggaggtaggctctgctggaccaacgaaccccttcgaggcgaggtggccaccagtgtggatttaattaccttgcataaccgagggtggcaagtgagaattgtgccagatgaattgacaactatcttccccgaatggaagtgcctggcacgcgaatatgtccaactcaacatcgctgccaaagagcgcgcggacaaggaaaagaaccaaaccatgcgatccattgccaaacttttatccaacgccctgtatggatcatttgccaccaaacttgacaataaaaaaattgtgttttctgaccaaatggacgaaaacctcatgaaaggcatctcaagcggcactgtcaatatcaaatcctcctcgttcttagaaactgacaacctgagtgcagaggtcatgcccgccttcgagagggaatacctaccccaacagctgacgttcctggacagcgatccggaagacagtgaggaagagcagagaaccgcccccttttatacccccccagctgggaccccaggtcacgtgaaatacacctacaagccaatcacattcctggatgttgaagagagtgacatgtgtttgcatactttggaaaaggtggaccccctggttgacaacgatcgctacccctcccacatagcctcctttgtgctggcctggacgcgcgcctttgtatcagagtggtcagagttcctatacgaagaagaccgaggcactccactggaaaagaggcctgtaaaatcagtctacggggacacggacagcctgtttgtcactcaacgaggacacgaactcatggagaccaaaggtaagaaacgcatcaaaaaatatggcggaaaacttgtttttgaccccaatgaaccggatttaacctggctggtggaatgtgaaactgtttgcgcctcctgcggcgcggatgcatactccccagaatccattttccttgcgcccaagctgtatgcgctgaaatgcctatactgcccggtatgcaagaaaacttccaaaggtaagctccgcgccaagggccacgcagccgaggcgctcaactacgaactcatggtaaactgctacttggccgacatacagggcgccaagcggcacaagttttcgaccagcaggatgagtctgaagcgcaccctggcaagcgcccaagcaggcgcacaccccttcactgtgacggaaacaaccctgacccgaactttgagaccctggaaggaccgaaccctggcagcgctggacgcccatcgtctcataccctactccaggagccgtccaaacccgcgaaacgaggaggtctgctggatcgagatgccatag

SEQ ID NO: 591 - DNA, 1047 bp, Adenovirus B14a
  MISC_FEATURE (1)..(1047): B14a.orf00045 IVa2 protein
atgcccatggctgacggtctaaaaccgctgaaaaacttttcctcactacaagaacttctatcactaggaggagagcgcctcctaatggatttggtgcgggaaaatatgcatgtaagggaaatgatgaacgaggtggcccccttgcttcgagaagacggcagttgccgttccctaaactaccaactgcaacctgtaatcggaatcatttatggccccaccggatgtggcaaatctcaattgctcagaaacttgctatcatcccaactaattaccccagccccagaaacggtgttctttatagccccccaggtggacatgattccaccctcggaactgaaagcttgggaaatgcaaatctgtgaggggaactatgctccggggcccgaaggaacattcataccccaatcgggtactctccgtcccaaatttattaaaatggcctatgatgatttaactcaggaacataactatgatgtgtcagacccacggaacgtgtttgcccgcgctgctgcccacggccctattgctattatcatggatgagtgcatggaaaatctcggaggacacaagggtgtctccaaatttttccacgcttttccatccaagctgcacgataaatttcctaaatgtaccggatacaccgtcttggtggtacttcataacatgaacccaagacgagatcttggcggcaatattgccaacttaaaaatccaatccaaaatgcacataatttcaccccgaatgcacccctcccagctcaaccggtttgtaaacacctacaccaagggcttatctgtggcaatcagcctacttctaaaagatattgtgcaacaccatgcacagcgaccttgttatgactgggtaatttacaacactaccccggagcatgaatcccttcaatggagctatctccaccccaaagacggcctaatgcccatgtatctaaacattcaatcccacctttataggattttggaaaaaatccaccgtgttctcaatgatcgagatcggtggtctagggcataccgtgcgcgaaaaatgaaataa

SEQ ID NO: 592 - DNA, 420 bp, Adenovirus B14a
  MISC_FEATURE (1)..(420): B14a.orf00046 IX pIX protein
atgagtggaaacgcttcttttaatgggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagccgccgctgccgcctctgttgccgctaacactgtgcttggaatgggttactatggaagcatcctggctaattccacttcctctaataacccttctaccctgactcaggacaagttacttgtccttttggcccagctggaggctttgacccaacgtctgggtgaactttctcagcaggtggccgagttgcgagtacaaactgagtctgctgtcggcacggcaaagtctaaataa

SEQ ID NO: 593 - DNA, 1122 bp, Adenovirus B14a
  MISC_FEATURE (1)..(1122): B14a.orf00049 E1B 54.9 kDa protein
atgagtcgcagacgtcctgaaaccatttggtggcatgaggtccagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactccagacaagacagttattagatgctgcatgatggatatgtggcctggagtagtcggtatggaagcagtaacttttgtaaatgttaagtttaggggagatggttataatggaatagtgtttatggccaataccaaacttatattgcatggttgtagcttttttggttttaacaatacctgtgtagatgcctggggacaggttagtgtacggggatgtagtttctatgcgtgttggattgccacagctggcagaaccaagagtcaattgtctctgaagaaatgcatattccaaagatgtaacctgggcattcttaatgaaggcgaagcaagggtccgccactgcgcttctacagatactggatgttttattttaattaagggcaatgccagcgtaaagcataacatgatttgcggtgcttccgatgagaggccttatcaaatgctcacttgtgccggagggcattgtaacatgctggctactgtgcatattgtttctcatcaacgcaaaaaatggcctgtttttgatcacaatgtgttgaccaagtgtaccatgcatgcaggtgggcgtagaggaatgtttatgccttaccagtgtaacatgaatcatgtaaaagtgttgttggaaccagatgccttttccagaatgagtctaacaggaatgtttgacatgaacatgcaaatctggaagatcctgaggtatgatgatacaagatcgagggtgcgcgcatgcgaatgcggaggcaagcatgccaggttccagccggtgtgtgtagatgtgactgaagatctgagaccggatcatttggttattgcccgcactggagcagagttcggatccagtggagaagaaactgactaa

SEQ ID NO: 594 - DNA, 543 bp, Adenovirus B14a
  MISC_FEATURE (1)..(543): B14a.orf00050 E1B 20 kDa protein
atggaggtttgggccattttggaagaccttagaaagactaggcaactgttagagaacgcttcggacggagtctccggtttttggagattctggttcgctagtgaattagctagggtagtttttaggataaaacaggactataaagaagaatttgaaaagttgttggtagattgtccaggactttttgaagctcttaatttgggccatcaagttcactttaaagaaaaagttttatcagttttagacttttcgaccccaggtagaactgccgctgctgtggcttttcttacttttatattagataaatggatcccgcagactcatttcagcaggggatacgttttggatttcgtagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtag

SEQ ID NO: 595 - DNA, 240 bp, Adenovirus B14a
  MISC_FEATURE (1)..(240): B14a.orf00051 E1A 25.7 kDa protein
ttgagtgggaaatttgtgcttcttattataggtcctgtgtctgatgctgatgagtcaccatctcctgattctactacctcacctcctgagattcaagcacctgttcctgtggacgtgcacaagcccattcctgtaaagcttaagcctggaaaacgtccagcagtggaaaaactcgaggacttgttacagggtggggacggacctttggacttgagtacacggaaacggccaagacaataa

SEQ ID NO: 596 - DNA, 591 bp, Adenovirus B14a
  MISC_FEATURE (1)..(591): B14a.orf00052 E1A 29.1 kDa protein
atgagacacttgcgatttatgcctcaggaaataatttctgctgagactggaaacgaaatactggagtttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcgatactccaggggtgattgtggaaagcggtacaggtgtaagaaaattacctgatttgggttccgtggactgtgatttgcactgctatgaagacgggtttcctttgagtgatgaggaggaccatgaaaaggagcagtctatgcagactgcagcgggtgagggagtgaaggctgccattggttttcagttggattgcccggagcttcctggacatggctgtaagtcttgtgaatttcacaggaaaaatactggagtaaaggaactgttatgttcgctttgttatatgagagcgcactgccactttatttacagtaagtgtgtttaa

SEQ ID NO: 597 - DNA, 129 bp, Artificial Sequence
  B14a.orf00054 hypothetical protein
ttgcgtcacatttaccgcgacaacttgcaaaaacactccacccccaaaaaacgtcattttcccacggccgcgccgccccttttagccgttaaccccacagccaattaccacacagcccacactttttaa

SEQ ID NO: 598 - DNA, 120 bp, Adenovirus B14b
  MISC_FEATURE (1)..(120): B14b.orf00001 E1A 6.5 kDa protein
ttgtgtcaagaggccactcttgagtgccagcgagaagagttttctcctctgcgccggcagtttaatattaaaaaaaatgagacacttgcgatttatgcctcaggaaataatttctgctga

SEQ ID NO: 599 - DNA, 198 bp, Adenovirus B14b
  MISC_FEATURE (1)..(198): B14b.orf00002 E1A 25.7 kDa protein
atgcctcaggaaataatttctgctgagactggaaacgaaatactggagtttgtggtgcacgccctgatgggagacgatccggagccacctgtgcagctttttgagcctcctacgcttcaggaactgtatgatttagaggtagagggatcggaggattctaatgaggaagctgtgaatggcttttttaccgatcaataa

SEQ ID NO: 600 - DNA, 177 bp, Artificial Sequence; identical to SEQ ID NO: 565
  B14b.orf00003 hypothetical protein

SEQ ID NO: 601 - DNA, 378 bp, Adenovirus B14b; identical to SEQ ID NO: 566
  MISC_FEATURE (1)..(378): B14b.orf00004 E4 ORF1 protein

SEQ ID NO: 602 - DNA, 429 bp, Adenovirus B14b; identical to SEQ ID NO: 567
  MISC_FEATURE (1)..(429): B14b.orf00006 E4 ORF2 protein

SEQ ID NO: 603 - DNA, 354 bp, Adenovirus B14b; identical to SEQ ID NO: 568
  MISC_FEATURE (1)..(354): B14b.orf00007 E4 ORF3 protein

SEQ ID NO: 604 - DNA, 900 bp, Adenovirus B14b; identical to SEQ ID NO: 569
  MISC_FEATURE (1)..(900): B14b.orf00010 E4 ORF6 protein

SEQ ID NO: 605 - DNA, 252 bp, Adenovirus B14b; identical to SEQ ID NO: 570
  MISC_FEATURE (1)..(252): B14b.orf00011 E4 ORF6/7 protein

SEQ ID NO: 606 - DNA, 978 bp, Adenovirus B14b; identical to SEQ ID NO: 138
  MISC_FEATURE (1)..(978): B14b.orf00012 L5 fiber protein

SEQ ID NO: 607 - DNA, 165 bp, Adenovirus B14b; identical to SEQ ID NO: 572
  MISC_FEATURE (1)..(165): B14b.orf00013 U protein

SEQ ID NO: 608 - DNA, 408 bp, Adenovirus B14b
  MISC_FEATURE (1)..(408): B14b.orf00015 E3B 15.3K protein
atgactgaaacactcaccacctccaattccgccgaggatctgcttgatatggacggccgcgtctcagaacagcgactcgcccaactacgcatccgccagcagcaggaacgcgtggccaaagagctcagagatgtcatccaaattcaccaatgcaaaaaaggcatattctgtttggtaaaacaagccaaaatatcctacgagatcaccgctaccgaccatcgcctctcttacgagcttggcccccaacgacaaaaatttacctgcatggtgggaatcaaccccatagttatcacccaacaaagtggagatactaagggttgcattcactgctcctgcgattccatcgagtgcacctacaccctgctgaagaccctatgcggactaagagacctgctacccatgaattaa

SEQ ID NO: 609 - DNA, 372 bp, Adenovirus B14b
  MISC_FEATURE (1)..(372): B14b.orf00016 E3 14.9 kDa protein
ttgcttccctacgctgtctcaaccccagctacctatagtactccaccagaacaccttagaaaatgcaaattccaacaaccgtggtcatttcttgcttgctatcgagaaaaatctgaaattcccccaactttaataatgattgctggaataattaatgtaatctgttgcaccataatttcatttctgatataccccctatttgattttggctggaatgctcccaatgcacatgattattcccaagacccagaggaacacattcccctacataacatgcaacaaccaatagcgctaatagaatacgaaagtgaaccacaacccccactactccctgctattagttacttcaacctaaccggcggagatgactga

SEQ ID NO: 610 - DNA, 276 bp, Adenovirus B14b
  MISC_FEATURE (1)..(276): B14b.orf00017 E3 10.1 kDa protein
atggtacctagaaatttcttcttcaccatactcatctgtgcttttaatgtttgcgctactttcacagcagtagccacagcaagcccagactgtataggagcatttgcttcctatgcactttttgcttttgtcacttgcatctgcgtatgtagcatagtctgcctggttattaattttttccaacttctagactggatccttgtgcgaattgcctacctgcgccaccatcccgaataccgcaaccaaaatatcgcggcacttcttagacttatctaa

SEQ ID NO: 611 - DNA, 552 bp, Adenovirus B14b
  MISC_FEATURE (1)..(552): B14b.orf00020 E3 20.8 kDa protein
atggtttccactaccacattccttatgcttactagtatagcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatccaccactccagcgccccgcaaaactactttctctagcagcagtgccgctaacaatacaatttccaatccaacctttaccgcgcttttaaaacgcactgtgaataattctacaacaatttccacttcaacaatcagcatcatcgctgccgtgacaattggaatatctattcttgtttttaccataacctactacacctgctgctataaaaaagacgaacataaaggtgatccattacttagatttgatatttaa

SEQ ID NO: 612 - DNA, 546 bp, Adenovirus B14b
  MISC_FEATURE (1)..(546): B14b.orf00021 E3 20.1 kDa protein
atggcttttcttacagctctcatacttgtcagcattgtcactgccgctcacggacaaacagtcgtctctatccctctaggtcataattacactctcataggacccccaatcacttcagaggtcatctggaccaaactgggaagcgttgattactttgatataatctgtaacaaaacaaaaccaataatagtaacctgcaacatacaaaatcttacattaattaatgttagcaaagtttacagcggttactattatggttatgacagatacagtagtcaatatagaaattacttggttcgtgttacccagtccaaaaccacgaaaatgccaaatatggcagaaattcgatccgatgacaattctctagaaacttttacatcttccaccacacctgacgaaaaaaatatcccagattcaatgattgcaattatcgcagcggtggcagtggtgatggcactaacagtaatatgcatgcttttatatgcttgtcgctacaaaaagtttcatcctaaaaaacaagatctcctactaaggcttaacatttaa

SEQ ID NO: 613 - DNA, 501 bp, Adenovirus B14b
  MISC_FEATURE (1)..(501): B14b.orf00022 E3 18.4 kDa protein
atggggcccatactagtcttgcttgttttactttcgcttttgggaccgggttctgccaactacaatccatgtctagactttgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacacttttattttttctacaatgtgcgatctggccatgttcatgagcaaacagtattctctatggcctcccagcaaggacaacattgtaacgttctccattgcttattgcttgtgcgcttgccttcttactgctttactgtgcgtatgcatacacctgcttgtaaccactcgtatcaaaaacgccaataacaaagaaaaaatgccttaa

SEQ ID NO: 614 - DNA, 396 bp, Adenovirus B14b; identical to SEQ ID NO: 574
  MISC_FEATURE (1)..(396): B14b.orf00024 E3 14.6 kDa protein

SEQ ID NO: 615 - DNA, 318 bp, Adenovirus B14b; identical to SEQ ID NO: 575
  MISC_FEATURE (1)..(318): B14b.orf00025 E3 11.7 kDa protein

SEQ ID NO: 616 - DNA, 684 bp, Adenovirus B14b; identical to SEQ ID NO: 576
  MISC_FEATURE (1)..(684): B14b.orf00026 L4 protein VIII

SEQ ID NO: 617 - DNA, 393 bp, Adenovirus B14b; identical to SEQ ID NO: 577
  MISC_FEATURE (1)..(393): B14b.orf00027 L4 33 kDa protein

SEQ ID NO: 618 - DNA, 2439 bp, Adenovirus B14b; identical to SEQ ID NO: 578
  MISC_FEATURE (1)..(2439): B14b.orf00030 L4 100 kDa hexon-assembly associated protein

SEQ ID NO: 619 - DNA, 1557 bp, Adenovirus B14b; identical to SEQ ID NO: 579
  MISC_FEATURE (1)..(1557): B14b.orf00031 E2A DNA binding protein

SEQ ID NO: 620 - DNA, 651 bp, Adenovirus B14b; identical to SEQ ID NO: 580
  MISC_FEATURE (1)..(651): B14b.orf00032 L3 23K proteinase

SEQ ID NO: 621 - DNA, 2838 bp, Adenovirus B14b; identical to SEQ ID NO: 198
  MISC_FEATURE (1)..(2838): B14b.orf00035 L3 hexon protein

SEQ ID NO: 622 - DNA, 741 bp, Adenovirus B14b; identical to SEQ ID NO: 582
  MISC_FEATURE (1)..(741): B14b.orf00038 L3 protein VI

SEQ ID NO: 623 - DNA, 231 bp, Adenovirus B14b; identical to SEQ ID NO: 583
  MISC_FEATURE (1)..(231): B14b.orf00040 L2 protein X

SEQ ID NO: 624 - DNA, 1056 bp, Adenovirus B14b; identical to SEQ ID NO: 584
  MISC_FEATURE (1)..(1056): B14b.orf00041 L2 protein V

SEQ ID NO: 625 - DNA, 579 bp, Adenovirus B14b; identical to SEQ ID NO: 585
  MISC_FEATURE (1)..(579): B14b.orf00042 L2 protein VII

SEQ ID NO: 626 - DNA, 1677 bp, Adenovirus B14b; identical to SEQ ID NO: 171
  MISC_FEATURE (1)..(1677): B14b.orf00043 L2 penton protein

SEQ ID NO: 627 - DNA, 1764 bp, Adenovirus B14b; identical to SEQ ID NO: 587
  MISC_FEATURE (1)..(1764): B14b.orf00047 L1 protein IIIa

SEQ ID NO: 628 - DNA, 1161 bp, Adenovirus B14b; identical to SEQ ID NO: 588
  MISC_FEATURE (1)..(1161): B14b.orf00050 L1 43 kDa protein

SEQ ID NO: 629 - DNA, 1917 bp, Adenovirus B14b; identical to SEQ ID NO: 589
  MISC_FEATURE (1)..(1917): B14b.orf00051 E2B terminal protein

SEQ ID NO: 630 - DNA, 3369 bp, Adenovirus B14b; identical to SEQ ID NO: 590
  MISC_FEATURE (1)..(3369): B14b.orf00052 E2B DNA polymerase

SEQ ID NO: 631 - DNA, 1041 bp, Adenovirus B14b
  MISC_FEATURE (1)..(1041): B14b.orf00053 IVa2 protein
atggctgacggtctaaaaccgctgaaaaacttttcctcactacaagaacttctatcactaggaggagagcgcctcctaatggatttggtgcgggaaaatatgcatgtaagggaaatgatgaacgaggtggcccccttgcttcgagaagacggcagttgccgttccctaaactaccaactgcaacctgtaatcggaatcatttatggccccaccggatgtggcaaatctcaattgctcagaaacttgctatcatcccaactaattaccccagccccagaaacggtgttctttatagccccccaggtggacatgattccaccctcggaactgaaagcttgggaaatgcaaatctgtgaggggaactatgctccggggcccgaaggaacattcataccccaatcgggtactctccgtcccaaatttattaaaatggcctatgatgatttaactcaggaacataactatgatgtgtcagacccacggaacgtgtttgcccgcgctgctgcccacggccctattgctattatcatggatgagtgcatggaaaatctcggaggacacaagggtgtctccaaatttttccacgcttttccatccaagctgcacgataaatttcctaaatgtaccggatacaccgtcttggtggtacttcataacatgaacccaagacgagatcttggcggcaatattgccaacttaaaaatccaatccaaaatgcacataatttcaccccgaatgcacccctcccagctcaaccggtttgtaaacacctacaccaagggcttatctgtggcaatcagcctacttctaaaagatattgtgcaacaccatgcacagcgaccttgttatgactgggtaatttacaacactaccccggagcatgaatcccttcaatggagctatctccaccccaaagacggcctaatgcccatgtatctaaacattcaatcccacctttataggattttggaaaaaatccaccgtgttctcaatgatcgagatcggtggtctagggcataccgtgcgcgaaaaatgaaataa

SEQ ID NO: 632 - DNA, 465 bp, Adenovirus B14b
  MISC_FEATURE (1)..(465): B14b.orf00054 IX pIX protein
atggacagattgagtaaaaatttgtttttctgtcttgcagctgtcatgagtggaaacgcttcttttaatgggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagccgccgctgccgcctctgttgccgctaacactgtgcttggaatgggttactatggaagcatcctggctaattccacttcctctaataacccttctaccctgactcaggacaagttacttgtccttttggcccagctggaggctttgacccaacgtctgggtgaactttctcagcaggtggccgagttgcgagtacaaactgagtctgctgtcggcacggcaaagtctaaataa

SEQ ID NO: 633 - DNA, 1221 bp, Adenovirus B14b
  MISC_FEATURE (1)..(1221): B14b.orf00057 E1B 54.9 kDa protein
gtgcttactggatctacgtccactggacgggataggggcgttaaaagggagagggcatctagtggtactgatgctagatctgagttggctttaagtttaatgagtcgcagacgtcctgaaaccatttggtggcatgaggtccagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactccagacaagacagttattagatgctgcatgatggatatgtggcctggagtagtcggtatggaagcagtaacttttgtaaatgttaagtttaggggagatggttataatggaatagtgtttatggccaataccaaacttatattgcatggttgtagcttttttggttttaacaatacctgtgtagatgcctggggacaggttagtgtacggggatgtagtttctatgcgtgttggattgccacagctggcagaaccaagagtcaattgtctctgaagaaatgcatattccaaagatgtaacctgggcattcttaatgaaggcgaagcaagggtccgccactgcgcttctacagatactggatgttttattttaattaagggcaatgccagcgtaaagcataacatgatttgcggtgcttccgatgagaggccttatcaaatgctcacttgtgccggagggcattgtaacatgctggctactgtgcatattgtttctcatcaacgcaaaaaatggcctgtttttgatcacaatgtgttgaccaagtgtaccatgcatgcaggtgggcgtagaggaatgtttatgccttaccagtgtaacatgaatcatgtaaaagtgttgttggaaccagatgccttttccagaatgagtctaacaggaatgtttgacatgaacatgcaaatctggaagatcctgaggtatgatgatacaagatcgagggtgcgcgcatgcgaatgcggaggcaagcatgccaggttccagccggtgtgtgtagatgtgactgaagatctgagaccggatcatttggttattgcccgcactggagcagagttcggatccagtggagaagaaactgactaa

SEQ ID NO: 634 - DNA, 543 bp, Adenovirus B14b; identical to SEQ ID NO: 594
  MISC_FEATURE (1)..(543): B14b.orf00058 E1B 20 kDa protein

SEQ ID NO: 635 - DNA, 225 bp, Adenovirus B14b
  MISC_FEATURE (1)..(225): B14b.orf00060 E1A 25.7 kDa protein
gtgcttcttattataggtcctgtgtctgatgctgatgagtcaccatctcctgattctactacctcacctcctgagattcaagcacctgttcctgtggacgtgcacaagcccattcctgtaaagcttaagcctggaaaacgtccagcagtggaaaaactcgaggacttgttacagggtggggacggacctttggacttgagtacacggaaacggccaagacaataa

SEQ ID NO: 636 - DNA, 573 bp, Adenovirus B14b
  MISC_FEATURE (1)..(573): B14b.orf00061 E1A 29.1 kDa protein
atgcctcaggaaataatttctgctgagactggaaacgaaatactggagtttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcgatactccaggggtgattgtggaaagcggtacaggtgtaagaaaattacctgatttgggttccgtggactgtgatttgcactgctatgaagacgggtttcctttgagtgatgaggaggaccatgaaaaggagcagtctatgcagactgcagcgggtgagggagtgaaggctgccattggttttcagttggattgcccggagcttcctggacatggctgtaagtcttgtgaatttcacaggaaaaatactggagtaaaggaactgttatgttcgctttgttatatgagagcgcactgccactttatttacagtaagtgtgtttaa

SEQ ID NO: 637 - DNA, 120 bp, Adenovirus B14b; identical to SEQ ID NO: 598
  MISC_FEATURE (1)..(120): B14b.orf00062 E1A 6.5 kDa protein

SEQ ID NO: 638 - DNA, 129 bp, Artificial Sequence; identical to SEQ ID NO: 597
  B14b.orf00064 hypothetical protein

SEQ ID NO: 639 - DNA, 378 bp, Adenovirus B34
  MISC_FEATURE (1)..(378): B34.orf00002 E4 ORF1 protein
atggctgatgaggctttgtatgtgtatttagagggaccgggggcgacgttgcctgaacagcagcagagaaataattatattttttattctcctgtgccttttactttgtatccgcgaggggtggctttgctatacttacgattaagcataattatacccaaaggctatgttggctgttttttctcgttaactgatgctaacatgtctggattgtatgcttcatcaagaattattcatgctggtcaccgcgaggaactttcggtgctgttgtttaatcaccatgacaggttttacgagggtcgagctggagaccctgtggcttgtcttgtgatggaaagactgatttatccacctgttcgtcaggctactatgatatga

SEQ ID NO: 640 - DNA, 390 bp, Adenovirus B34; identical to SEQ ID NO: 527
  MISC_FEATURE (1)..(390): B34.orf00003 E4 130 aa

SEQ ID NO: 641 - DNA, 354 bp, Adenovirus B34
  MISC_FEATURE (1)..(354): B34.orf00004 E4 117 aa
atgagggtgtgtttaagaatggtggtggagggcgccctccgggacctgtttgtaatgtgtggattggatttaccacaagaactgacacgaataattcaaggctggaaagctgaaaattatctgggaatggtgcaggaatgtaatatgatgattgaggagttagaaaatgctccttcttttggtattcttttgttcttggatgtgcgcgtggaggctttgttggaagccaccgttgagcaccttgaaaatcgcatttcttttgatttagctgtgctttttcaccaacacagtgggggcgagagatgccatctgcgcgatctacaatttgaagtactgcgagatcgtttggaataa

SEQ ID NO: 642 - DNA, 900 bp, Adenovirus B34
  MISC_FEATURE (1)..(900): B34.orf00007 E4 ORF6 protein
atgtcaggaagcaactccattatgacaaggttgcgcgcacgctcgacatcatgcgccagacatcacccttacaccagagcccagttaccacgttgtgaggaaaatgaaacccgagcttctatgactgaagaccacccgctgttgccagattgtgatactatgactatgcatagtgtaagttgtgttcgtggtcttccttgttctgccagctttactgttctgcaagagcttcctattccctgggatatgtttctaaatcctgaggagttaaaaattatgagaagatgcatgcatttatgtctatgttgtgccactatagatatttttcattctcaagtgattcacggtcgagagaattgggttcttcattgtcattgtaatcagcagggttcacttcaatgcatggctgggggagcggtgttggcagtgtggttccggaaggttatattgggttgcatgattaaccaacgttgtccatggtacagacagattgttaatatgcacatgccaaaagagatcatgtatgtgggtagtgtgtttttgagggaacgtcatttaatttatattaaactttggtatgatggtcatgcaggggcgattatatcagatatgagttttggctggagcgcttttaattatggtttattaaacaatattgtaataatgtgttgtacctactgcaaagatttgagtgaaatcagaatgcgttgctgcgcgcatcgcaccagaaagttgatgttaagggctattaaaatcatgcttcaggacactgtggaccctgatcccataaacagcagttgcacggagcgacgcagacagcggctgcttgtgggtttgatgagacacaatcgtccgataccgttttcggattatgattcccatcgttcttcttccagatga

SEQ ID NO: 643 - DNA, 252 bp, Adenovirus B34
  MISC_FEATURE (1)..(252): B34.orf00008 E4 ORF6/7 protein
atgaccgtgatccagactccggattcgcatccgcagcagttggactgtgaaagcgctttaaaagactatcgcgatggatttttatctatcactgaccccagattggctcgctctgaaactgtttggaatgtggaatctaaaacaatgtctatctctaatggtatccaaatgtttaaagctgtgcgtggggagagattggtgtattctgtcaaatgggaaggtggaggcaaaataactactcgaattttgtga

SEQ ID NO: 644 - DNA, 972 bp, Adenovirus B34; identical to SEQ ID NO: 140
  MISC_FEATURE (1)..(972): B34.orf00009 L5 fiber protein

SEQ ID NO: 645 - DNA, 165 bp, Adenovirus B34; identical to SEQ ID NO: 532
  MISC_FEATURE (1)..(165): B34.orf00010 U protein

SEQ ID NO: 646 - DNA, 408 bp, Adenovirus B34
  MISC_FEATURE (1)..(408): B34.orf00012 E3B 15.3K protein
atgactgaaacactcaccacctccaattccgccgaggatctgctcgatatggacggccgcgtctcagaacagcgacttgcccaactacgcatccgccagcagcaggaacgcgcggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaa

SEQ ID NO: 647 - DNA, 405 bp, Adenovirus B34; identical to SEQ ID NO: 534
  MISC_FEATURE (1)..(405): B34.orf00013 E3 14.9 kDa protein

SEQ ID NO: 648 - DNA, 276 bp, Adenovirus B34
  MISC_FEATURE (1)..(276): B34.orf00014 E3B 10.3K protein
atggtacctagaaatttcttcttcaccatactcatttgtgcatttaatgtttgcgctactttcacagcagtagccacagcaaccccagactgtataggagcatttgcttcctatgcactttttgcttttgttacttgcatctgcgtatgtagcatagtctgcctggttattaattttttccaacttctagactggatccttgtgcgaattgcctacctgcgccaccatcccgaataccgcaaccaaaatatcgcggcacttcttagactcatctaa

SEQ ID NO: 649 - DNA, 564 bp, Adenovirus B34
  MISC_FEATURE (1)..(564): B34.orf00016 E3A 20.6K protein
atggtttccactaccacattccttatgcttactagtcttgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcattatcgctgcagtgacaattggaatatctattcttgtttttaccataacctactacgcctgctgctatagaaaagacaaacataaaggtgatccattacttagatttgatatttaa

SEQ ID NO: 650 - DNA, 546 bp, Adenovirus B34
  MISC_FEATURE (1)..(546): B34.orf00017 E3A 20.3K protein
atggcttctcttacatctctcatatttgtcagcattgtcactgccgctcacggacaaacagtcgtctctatccctctaggacataattacactctcataggacccccaatcacttcagaggtcatctggaccaaactgggaagcgttgattactttgatataatctgcaacaaaacaaaaccaataatagtaacttgcaacatacaaaatcttacattgattaatgttagcaaagtttacagcggttactattatggttatgacagatacagtagtcaatatagaaattacttggttcgtgttacccagttaaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaa

SEQ ID NO: 651 - DNA, 501 bp, Adenovirus B34; identical to SEQ ID NO: 538
  MISC_FEATURE (1)..(501): B34.orf00019 E3A 18.5K protein

SEQ ID NO: 652 - DNA, 396 bp, Adenovirus B34
  MISC_FEATURE (1)..(396): B34.orf00021 E3 14.6 kDa protein
atgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcctagtggtgttgtggtattggtttaaaaaatggggcccatactag

SEQ ID NO: 653 - DNA, 318 bp, Adenovirus B34
  MISC_FEATURE (1)..(318): B34.orf00022 E3 11.7 kDa protein
atgtctggtgacgcggctgagctatctcggctgcgacatctagaccactgccgccgctttcgctgctttgcccgggaactcattgagttcatctacttcgaactccccaaggatcaccctcaaggtccggcccacggagtgcggattactatcgaaggcaaaatacactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactga

SEQ ID NO: 654 - DNA, 684 bp, Adenovirus B34
  MISC_FEATURE (1)..(684): B34.orf00023 L4 protein VIII hexon associated protein
atgagtaaagaaattcccacgccttacatgtggagttatcagccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagcgggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcactacccggacgagttcataccgaacttcgacgcgattagcgagtcagtggacggctacgattga

SEQ ID NO: 655 - DNA, 393 bp, Adenovirus B34
  MISC_FEATURE (1)..(393): B34.orf00024 L4 33K protein
atgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggccaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtag

SEQ ID NO: 656 - DNA, 2442 bp, Adenovirus B34
  MISC_FEATURE (1)..(2442): B34.orf00027 L4 100 kDa hexon-assembly associated protein
atggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagccagacatcgaacaagacccgggctatgtgacaccggtggaacacgaggaagagttgaaacgctttctagagagagaggatgaaaactgcccaaaacagcaagcggataactatcaccaagatgctggaaatagggatcagaacaccgactacctcatagggcttgacggggaagacgcgctccttaaacatctagcaagacagtcactcatagtcaaggatgcattattggacagaactgaagtgcccatcagtgtcgaagagctcagccgcgcctacgagcttaacctattttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcgtcgaggtcacacactttgcataccccgctgtcaacctgccccctaaagtcatgacggccgtcatggaccagttactcattaagcgcgcaagtcccctttcagaagacatgcatgacccagatgcctgtgatgagggtaaaccagtggtcagtgatgagcagctaacccgatggctgggcaccgactctccccgggatttggaagagcgtcgcaagcttatgatggccgtggtgctggttaccgtagaactagagtgtcttcggcgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcacccttaagggggaagcccgccgtgattacatccgcgattgtgtttatctctacctgtgccacacgtggcaaaccggcatgggtgtatggcagcaatgtttagaagaacagaacctgaaagagctaaacaagctcttacagaaatctcttaaggttctgtggacagggttcgacgagcgcaccgtcgcttccgacctggcagacctcatcttcccagagcgtctcagggttactttgcgaaacggactgcctgactttatgagccagagcatgcttaacaattttcgctctttcatcctggaacgctccggtatcctgcccgccacctgctgcgcactgccctccgactttgtgcctctcacctaccgcgaatgccccccgccgctatggagtcactgctacctgttccgtctggccaactacctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgccccggaagattaccacccctatgaaatcaagttctatgaggaccaatcacagcctccgaaagccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaagcaagaagttgaaggtgcagccgccgcccccagaagatatggaggaagattgggacagtcaggcagaggaagcggaggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtag

SEQ ID NO: 657 - DNA, 1557 bp, Adenovirus B34
  MISC_FEATURE (1)..(1557): B34.orf00029 E2A DNA binding protein
atggccagccgcgaaggaaatcagttaagcgaccgccacagggagcacacccccgaacgcggaaggggttctgccagtcatccgccttccaggtcggaccgcagcccttcgcaatcgcctccacctctgcccccgaagagaaacacctgtcgccgtgtggggtcaggttcttctaccgacagtcagttggtaatggtgagcgaaacgtcacaatcctccctgtctccggaacggagcgacagtcctcctcctccgatacccccgaaaaagaagccaaggaagaccaaacatgtccccatgcaagacatcagtcaagacagcgaagaagaaagagaagaggcgcaacttgtagcagtgggtttcagctacccgcccgtgcgcatcgttgagaaggatggcaaaagaagcattgagaagatcgccaaagatgaccctctggctaaaggagctgctgcctgcactgttaagaatccgattagcttgcccctggtgtctgcttgggagaaaggcatggaagtgatgtgtctgctgatggagaagtacaggctggataacgaacttagaacctcttttaaactaatgcctgagcagcacgaacaatacaagcgcatctgtcaccagtacgtgaacgaggagcaccgaggcatccagttaactttcactagtcacaagacactgagcacgatgatgggaagatttctgcagggaatgatacattctttttctcagatcgcccaccataattgggaatgtacaggctgtgcgttgtggcctcatggctgcaatgattatgagggcaagctgaagtgcttgcatggcaatattatgattcagaaggagcagattatcgagatggatgtggccagcgagaacggacaacgagccttgaaggagaatcccgagcgaaccaaaatcacccaaaaccgctggggcagaagtgtggtgcaaatagccaacaatgacgcccgctgctgtgtgaatgatgccggctgcgcagctaaccagttttcgagcaggtcctgcgggatgttttataccgagggtagtaaagcccagcaggctttcaagcaatatgatgctttcatgagagccgtgtatccaggaatcagacaggatcaggccaagatgatactgatccccctgcactgcgattgtaaccacaagcctaattgggtgcccgccatgggtaggcagacctgcaagatgaccccgttcagcattgccaatgctgaagatctggatgtgggcatgattgcagatcccaccgtgctggcaagcgtaagacatccgtcgctgatggtgtttcagtgctgcaatccggtgtaccgcaactctcgcgctcagagcactggtcctaattgtgatttcaagatttcggctcctgacctgctgggagctttgcagctgaccagaaagctgtggagtgacatcctgcccgatataccggttcccaagttggtgattcccgaattcaagtggcaacccaagtatcagttccgcaacgtatcactgcctgcgggtcattctgattctcgtcagaacccattcgacttgtaa

SEQ ID NO: 658 - DNA, 630 bp, Adenovirus B34
  MISC_FEATURE (1)..(630): B34.orf00030 L3 23 kDa protein
atggcctgcggatcccaaaacggctccagcgagcaagagctcagagccattgtccaagacctgggttgcggaccatattttttgggaacctttgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccggtgtattacgctggaaaaatctacccagaccgtgcagggcccccgttctgccgcctgcggacttttctgctgcatgttccttcatgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttctcaatacccattcgccttattttcgctctcatcgtacacacatcgaaagggccactgcgttcgaccgtatggatgtgcaataa

SEQ ID NO: 659 - DNA, 2856 bp, Adenovirus B34; identical to SEQ ID NO: 200
  MISC_FEATURE (1)..(2856): B34.orf00032 L3 hexon protein

SEQ ID NO: 660 - DNA, 741 bp, Adenovirus B34
  MISC_FEATURE (1)..(741): B34.orf00033 L3 protein
atggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggtatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagcccctatggccaccggggtgatgaaaccttctcagttgcatcgacccgtcaccttggatttgccccctcctcctgctgctactgctgtacccgcttctaagcctgtcgctgccccgaaaccagtcgccgtagccaggtcacgtcccgggggcgctcctcgtccaaatgcacactggcaaaatactctgaacagcatcgtgggtctaggcgtgcaaagtgtaaaacgccgtcgctgcttttaa

SEQ ID NO: 661 - DNA, 231 bp, Adenovirus B34
  MISC_FEATURE (1)..(231): B34.orf00035 L2 protein X
atggccctcacttgtcgccttcgcgttcccatcactggttaccgaggaagaaactcgcgccgtagaagagggatgttggggcgcggaatgcgacgctacaggcgacggcgtgctatccgcaagcaattgcggggtggttttttgccagccttaattccaattatcgctgctgcgattggcgcaataccaggcatagcttccgtggcggttcaggcctcgcaacgacattga

SEQ ID NO: 662 - DNA, 1056 bp, Adenovirus B34
  MISC_FEATURE (1)..(1056): B34.orf00036 L2 protein V
atgtccaagcgcaaatacaaggaagaaatgctgcaggttatcgcacctgaagtctacggccaaccgttgaaggatgaaaaaaaaccccgcaaaatcaagcgggtaaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcagctgaccgattaggcgagtttgcttatggcaagcgtagtagaataaatcccaaggatgaaacagtgtccatacccttggatcatggaaatcccacccctagtcttaaaccggtcactttgcagcaagtgttacccgtaactccgcgaacaggtgttaaacgcgaaggtgaagatttgtatcccactatgcaactgatggtgcccaaacgccagaagttggaggacgttttggagaaagtaaaagtggatccagatattcaacctgaggttaaagtgagacccattaagcaggtagcgcctggtctgggagtacaaactgtagacattaaaattcccactgaaagtatggaagtgcaaactgaacccgcaaagcctactgccacctccactgaagtgcaaacggacccatggatgcccatgcctattacaactgacgccgtcggtcccactcgaagatcccgacgaaagtacggtccagcaagtctgttgatgcccaactatgtcgtacacccatctattattcctactcctggttaccgaggcactcgctactatcgcagccgaaacagtacttcccgccgtcgccgcaagacacctgcaaatcgcagtcgtcgccgtagacgcacaagcaaaccgattcccggcgccctggtgcggcaagtgtaccgcaatggtagtgcggaacctttgacactgccgcgtgcgcgttaccatcctagtatcatcacttaa

SEQ ID NO: 663 - DNA, 1677 bp, Adenovirus B34; identical to SEQ ID NO: 172
  MISC_FEATURE (1)..(1677): B34.orf00038 L2 penton

SEQ ID NO: 664 - DNA, 1764 bp, Adenovirus B34
  MISC_FEATURE (1)..(1764): B34.orf00041 L1 protein IIIa
atggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgcgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtatatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcattggtgctaccgcggctgagcccgagtctgcaagtccttttcctagtctacccttttctctacacagtgtacgtagcagcgaagtgggtagaataagtcgcccgagtttaatgggcgaagaggagtacctaaacgattccttgctcagaccggcaagagaaaaaaatttcccaaacaatggaatagaaagtttggtggataaaatgagtagatggaagacttatgctcaggatcacagagacgagcctgggatcatggggactacaagtagagcgagccgtagacgccagcgccatgacagacagaggggtcttgtgtgggacgatgaggattcggccgatgatagcagcgtattggacttgggtgggagaggaaggggcaacccgtttgctcatttgcgccctcgcttgggtggtatgttgtaa

SEQ ID NO: 665 - DNA, 1161 bp, Adenovirus B34
  MISC_FEATURE (1)..(665): B34.orf00042 L1 43 kDa protein
atgcatcccgtgctgcgacagatgcgtccccaacaacagcccccctcgcagcagcagcaaccacaaaaggctgtccctgcaactactgcaactgccgctgtgagcggtgcgggacagcccgcctatgatctggacttggaagagggcgaaggactggcacgtctaggtgcgccttcgcccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggacagaagacgagtgttgcgggacgaggatttcgaagttgatgaagtgacagggatcagtcctgccagggcacacgtggctgcagccaaccttgtatcggcttacgaacagacagtaaaggaagagcgtaatttccaaaagtcttttaataatcatgtgcgaaccctcattgcccgcgaagaagtcacccttggtttgatgcatttgtgggatttgatggaagctatcattcagaaccctactagcaaacctctgaccgcacagctgtttctggtggtgcaacacagcagagacaatgaggctttcagagaggcgctgctcaacatcaccgaacccgaggggagatggttgtatgatcttatcaacattctacagagtatcatagtgcaggagcggagcctgggcctggccgagaaggtggctgccatcaattactcggttttgagcttgggaaagtattacgctcgcaagatctacaagactccatacgttcccatagacaaggaggtgaagatagatgggttctacatgcgcatgacgctgaaggtgttgaccctgagcgatgatcttggggtgtaccgcaatgacagaatgcatcgcgcggtgagcgccagcaggaggcgcgagttaagcgacagggaactgatgcacagtttgcaaagagctctaactggagctggaaccgagggtgagaattactttgatatgggagctgacttgcagtggcagcctagtcgcagggctctgaacgccgcgacggcaggatgtgagcttccttacatagaagaggcggatgaaggcgaggaggaagagggcgagtacttggaagactga

SEQ ID NO: 666 - DNA, 1917 bp, Adenovirus B34
  MISC_FEATURE (1)..(1917): B34.orf00045 E2B terminal protein
atgaactacttcatgccgctacgcaacatttggaaccgcgtacgcgagtttcctcgggcttctactaccgccgcaggaatcacctggatgtccaggtacatctacggctatcaccgccttatgttggaagacctcgcccccggcgctccagctacagaacgatggcctctctaccgccaaccaccgccgcattttcttataggttaccagtatctggtgcgcacctgcaacgattacatctttgacacccgcgcctattcgcgccttaaatacaccgagctcgtgcgccctggtcaccagacagttaactggtcagtcatggccaactgtgcttacaccattaataccggggcttaccaccgctttgtggattttgatgactttcaagccaccctcacccaagtacagcaagccatcctcgccgaaagagtcgtagctgacttggcactggtacaaccaatgcgcgggtttggactcacacgtatgcatggcagaacgggtgaggaagaagtgcccgtagaacggctcatgcaagactactacaaagatcttgctagatgtcaggataatgcttggggaatggccaatcgcctgcgtatccagcaagccggacccaaagacctggtgctcctcgccaccatccgccgtcttagaactgcctactttaatttcatcaccagcagcatcgtctcaccttcccgagatgaagaagaaacagaagacccagaccgaacacataaccacccccgcccacaagaagccgtactcagcctaccttgtgactgtgactggttagacgctttcgtcgaaaggttttcagatcccgtggatcttgacacgatcagatctctgcgcgcagtccctacgggccaattaataaaatgtataatcagcgccctctccctcccaaacggagaacctcccagtcaccactttaaggagatgcgcggcggtgtttttactctgcgaccgcgcgagaacggccgcgccgtcactgaaaccatgcgccgccgccgcggagaggtcattgaacgattcatcgaccgtttgcccgtgcgccgtcgacgtcgccgtgtgccccctccgcccccgcctgaagacgaagaagagatgttagtggaagaagagatagaagaggaagaagagatcccgggagccttcgaacgcgaagtacgggccaccatagccgaactcatccgtcttctcgaggaggaattgaccgtgtccgcgcgaaactcccagttttttaattttgccgtggacttctacgaggccatggagcgcttggaagctctgggcgatgtcagcgaaatgccgctgagacgatggatcatgtatttcttcgtcgccgaacacattgccaccacactcaactacctttttcagcgcctatgcaactatgcggtcttcaccagacacgtggagcttaacctcgctcaggtggtgatgcgcgcaagagactccgagggggccgtggtttacagccgcgtctggaacgaggcgggcatgactgcattctcccaactcatgggccgtatctccaatgacctcgcggccaccgtcgagagagcgggtcgcggagatcttcaggaggaagaaatcgagcagttcatggcggagatcgcctaccaggacaactctggtgacgtacaagaaatactgagacaagctgccgttaacgataccgaaattgattctgttgaactctctttcaggttcaagctcacggggccggtagctttcacccagagacgtcagatacaagacgtcaatcgacgcgtggtggcgcacgcaagtcttctcagagcgcagtaccagaacctgcccgtgcgcggcgccgacgtgccactaccagccatgcctccgggtccggaacaaccgcttccgcccggcgcgcgtccccgtcatcgcttctga

SEQ ID NO: 667 - DNA, 3369 bp, Adenovirus B34
  MISC_FEATURE (1)..(3369): B34.orf00046 E2B DNA polymerase
atgcaagaagcaagagagccaccaccgatcaaaagaaaaaacaaaggtacggtagtggcgcccaaaggacacggaaccctgcaagccattgacatctctacaaacgaacctgtggaaatcaagtaccatctgaacctcccgcacgccctggaaaagatcatgcaagttaatcttctgtccctacctactaacctgagtccgcagcgtctcaggactctggacagctccagcctgcgcgctctggtccttcagctccgcccctcccgcgccgaggtctggacttgcctcccgcgggggctcgtcagcatgaccaccaccgaaacagaagatgaacaggccgatacagcgaatatagaagagcacgagatacaatcgccaggcctcggcttcccactgaaatttctcgtcaagggaagccaggtacagctcattcacgagatacaacccgtgcaacgctgcgactactgcggccgtctgtacaagcacaaacacgaatgctcggcgcgccgcagaaacttctacttccatcacatcaacagccaatcctccaactggtggcaggaaatccagttcttcccgatcggctctcatcctcgcacagaaagactcttcctgacctacgatgtggaaacttacacctggatggggtcctttggcaaacaactagttcctttcatgctggtcatgaaactctcaggagaagagcgtctcgtcaacatggcccacgatctagccattaaactaaagtgggatcgatggcaacaagaccccagaaccttctactgtgtcactccagaaaaaatggcaattggccagcattttcgtcagtatcgggaccagttacaaacagcactggcggtggatctttggtcatcattcctacatgcaaatcctcacctgcacgaatgggctctcgaacactacgccttatctgaccctacagacctaacctttgatgagctcaataagctacctcacgtcaaaggcacgccgcgtttcatagaattatacatcgtaggacacaacatcaacggtttcgacgagatcgtcctagctgcccaggtgatcaacaatcgagcggaagtaccacagcctttccgcatcactcgcaattttatgcccagagccggtaagattctcttcaacgatgttactttcgctttgcccaaccccgcctacaagaaacgggtagacttccaactctgggaacagggagcctgtgacgacatggacttcaaataccaatttctcaaagtcatggtcagagacaccttcgcccttactcacgcttcgctgcgaaaagctgctcaagcatactctctacccgtagagaagggctgctgcccttacaaggcagttaatcagttctacatgctaggatcttaccgtgcagacaaagacgggtttccgctagaagagtactggaaggatcgcgaagaataccttctcaaccgcgaactgtgggaaaagaaaaaccaaccaggttatgacatcattcaagaaacacttgactactgcgccctagacgtacttgtcaccgccgaactggtaaccaagcttcaagaatcttatgcccactttgtcagagactctgtaggtctacctcatgcccatttcaacatttttcaaagacccaccatctcttccaattctcacgccatctttcgccagattgtctacagaacagaaaaacccaatcgcaccaacttgggtccggggttgctagcgccatcacatgaactatatgactatgtgcgagcaagtatcagaggggggcgatgctatccaacctatataggcatctttgaggatcccatctacgtctatgacatctgtggcatgtatgcctctgcactcacccatcccatgccctggggcagtccccttaacccatatgagcgtgcactggcagctcgagaatggcaaatggccttagatgaccccactcccatcagctattttgataaggatttacttccgggaatctttaccatggatgcagaccctcccgatgaacttatgctagacccacttccccctttctgttctaggaaaggaggtaggctctgttggaccaacgaaccccttcgaggcgaggtggccaccagtgtggatttaattaccttgcataatcgagggtggcaagtgagaatcgtgccagatgaattgacaactatcttccccgaatggaagtgcctagcacgcgagtatgtccaactcaacatcgctgccaaagagcgcgcggacaaggaaaagaaccaaaccatgcgatccattgccaaacttttatccaacgccctgtatggatcatttgccaccaaacttgacaataaaaaaattgtgttttctgaccaaatggacgaaaacctcatgaaaggcatctcaaccggcactgtcaatatcaaatcctcctcgttcttagaaactgacaacctgagtgcagaggtcatgcccgccttcgagagggaatacctaccccaacagctgacgttcctggacagcgatccggaagacagtgaggaagagcaaagaaccgcccccttttatacccccccagcggggaccccaggtcacgtgaaatacacctacaagccaatcacattcctggatgttgaagagggtgacatgtgtttgcatactttggaaaaggtggaccccctggttgacaacgatcgctacccctcccacatagcctcctttgtgctggcctggacgcgcgcctttgtatcagagtggtcagagttcctgtacgaagaagaccgaggcactccactggagaagaggcctgtaaaatcagtctacggggatacggacagcctgtttgtcactcaacgaggacacgaactcatggagaccaaaggtaagaaacgcatcaaaaaatatggcggaaaacttgtttttgaccccaatgaaccggatttaacctggctggtggaatgtgaaactgtttgcgcctcctgcggcgcagatgcatactccccagaatccattttccttgcgcccaagctgtatgcgctgaaatgcctatactgcccggtatgcaagaaaacttccaaaggtaagctccgcgccaaaggccacgcagccgaggcgctcaactacgaactcatggtaaactgctacttggccgacatacagggcgccaagcgacagaagttctccaccagcagaatgagtctgaagcgcaccctggcaagcgcccaagcaggcgcacaccccttcactgtgacggaaacaaccctgactcgaacactgagaccctggaaggaccgaaccctggcagcgctggacgcccatcgtctcataccctactccaggagccgtccaaacccgcgaaacgaggaggtctgctggatcgagatgccatag

SEQ ID NO: 668 - DNA, 1047 bp, Adenovirus B34
  MISC_FEATURE (1)..(1047): B34.orf00047 E2B protein IVa2
atgcccatggctgacggtctaaaaccgctgaaaaacttttcctcactacaagaacttctatcactaggaggagagcgcctcctaatggatttggtgcgggaaaatatgcatgtaagggaaatgatgaacgaggtggcccccttgcttcgagaagacggcagttgccgttccctaaactaccacctgcaacctgtaatcggaatcatttatggccccaccggatgtggcaaatctcaattgctcagaaacttgctatcatcccaactaatcacccccgccccagaaacggtgttcttcatagccccccaggtggacatgattccaccatcggaactgaaagcttgggaaatgcaaatctgtgaggggaactatgctccggggcccgaaggaacattcataccccaatcgggtactctccgccccaaattcattaaaatggcttatgatgatttaactcaggaacataactatgatgtgtcagacccacggaacgtgtttgcccgcgctgctgcccacggccccattgctattatcatggatgagtgcatggaaaatctcggaggacacaagggtgtctccaaatttttccacgcttttccatccaagctacacgataaatttcctaaatgtaccggatacaccgtcttggtggtccttcataacatgaacccaagacgagatcttggcggcaatattgccaacttaaaaatccaatccaaaatgcacataatttcaccccgaatgcacccctcccagctcaaccggtttgtaaacacctacaccaagggcttatctgtggcaatcagcctacttctaaaagatattgtgcaacaccatgcactgcgaccttgttatgactgggtgatttacaacactaccccggagcatgaatcccttcaatggagctatctccaccccaaagatggcctaatgcccatgtatctaaacattcaatcccacctctataggattctggaaaaaatccaccgtgttctcaatgatcgagatcggtggtctagggcataccgtgcgcgaaaaatgaaataa

SEQ ID NO: 669 - DNA, 330 bp, Adenovirus B34
  MISC_FEATURE (1)..(330): B34.orf00049 IX hexon associated protein IX
atgggatctactgtggatggaagacccgtccaacccgccaattcttcaacgctgacctatgctactttaagttcttcacctttggacgcagctgcagccgccgccgccgcctctgttgccgctaacactgtgcttggaatgggttactatggaagtatcgtggctaattccacttcctctaataacccttctaccctgactcaggacaagttacttgtccttttggcccagctggaggctttgacccaacgtctgggtgaactttatcagcaggtggccgagttgcgagtacaaactgagtctgctgtcggcacggcaaagtctaaataa

SEQ ID NO: 670 - DNA, 1122 bp, Adenovirus B34
  MISC_FEATURE (1)..(1122): B34.orf00055 E1B 54.9 kDa protein
atgagtcgcagacgtcctgaaaccatttggtggcatgaggtccagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggagtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatattccaaagatgtaacctgggcattctgaatgaaggcgaagcaagggtccgccactgcgcttctacagatactggatgttttattttaattaagggcaatgccagcgtaaagcataacatgatttgcggtgcttccgatgagaggccttatcaaatgctcacttgtgccggtgggcattgtaatatgctggctactgtgcatattgtttcccatcaacgcaaaaaatggcctgtttttgatcacaatgtgttgaccaagtgtaccatgcatgcaggtgggcgtagaggaatgtttatgccttaccagtgtaacatgaatcatgtgaaagtgttgttggaaccagatgccttttccagaatgagcctaacaggaatctttgacatgaacatgcaaatctggaagatcctgaggtatgatgatacgagatcgagggtgcgcgcatgcgaatgcggaggcaagcatgccaggttccagccggtgtgtgtagatgtgactgaagatctgagaccggatcatttggttattgcccgcactggagcagagttcggatccagtggagaagaaactgactaa

SEQ ID NO: 671 - DNA, 543 bp, Adenovirus B34
  MISC_FEATURE (1)..(543): B34.orf00056 E1B 20 kDa protein
atggaggtttgggccattttggaagaccttagaaagactaggcaactgttagaggacgcttcggacggagtctccggtttttggagattctggttcgctagtgaattagctagggtagtttttaggataaaacaggactataaagaagaatttgaaaagttgttggtagattgcccaggactttttgaagctcttaatttgggccatcaagttcactttaaagaaaaagttttatcagttttagacttttcaaccccaggtagaactgccgctgctgtggcttttcttacttttatattagataaatggatcccgcagactcatttcagcaggggatacgttttggatttcgtagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtag

SEQ ID NO: 672 - DNA, 261 bp, Adenovirus B34
  MISC_FEATURE (1)..(261): B34.orf00057 E1A 231 R
atgctgtttttcacatgtatattgagtgggagttttgtgcttcttattataggtcctgtgtctgatgctgatgagtcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacggccaagacaataa

SEQ ID NO: 673 - DNA, 840 bp, Adenovirus B34
  MISC_FEATURE (1)..(840): B34.orf00058 E1A 29.1 kDa protein
atgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctacggtatttatacctcagggtttgtgtcaagaggccactcttgagtgccagcgagaagagttttctcctctgcgccggcagtttaataataaaaaaatgagagatttgcgatttctgcctcaggaaataatttctgctgagactggaaatgaaatactggagcttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcgatactccaggggtgattgtggaaagcggtacaggtgtaagaaaattacctgatttgggttccgtggactgtgatttgcactgctatgaagacgggtttcctccgagtgatgaggaggaccatgaaaaggagcagtctatgcagactgcagcgggtgagggagtgaaggctgccagtgttggttttcagttggattgcccggagcttcctggacatggctgtaagtcttgtgaatttcacaggaaaaatactggagtaaaggaactgttatgttcgctttgttatatgagagcgcactgccactttatttacagtaagtgtgtttaa

SEQ ID NO: 674 - DNA, 129 bp, Artificial Sequence
  B34.orf00060 hypothetical protein
atgcgtcacatttcccgcgacaacttgcaaaaaaactccacccccacaaaacgtcattttcccacggccgcgccgccccgtttagccgttaaccccacagccaatcaccacacaccccacaatttttaa

SEQ ID NO: 675 - DNA, 126 bp, Artificial Sequence
  B35.orf00001 hypothetical protein
atgctcgagcggccgccagtgtgctggaattcgcccttgtttaaacgcgatcgctgcaggttaattaaggaagggcgaattctgcagatatccatcacactggcggccgctcgagcatgcatctag

SEQ ID NO: 676 - DNA, 378 bp, Adenovirus B35
  MISC_FEATURE (1)..(378): B35.orf00002 E4 ORF1 protein
atggctgatgaggctttgtatgtgtatttagagggaccgggggcgacgttgcctaaacagcagcagagaaataattatattttttattctcctgtgccttttactttgtatccgcgaggggtggctttgctatacttacgattaagcataattatacccaaaggctatgttggctgttttttctccttaactgatgctaacatgtctggattgtatgcttcatcaagacttattcatgctggtcaccgcgaggaactttcggtgctgttgtttaatcacgatgacaggttttacgagggtcgagctggagaccctgtggcttgtcttgtgatggaaagactgatttatccacctgttcgtcaggctactatgatatga

SEQ ID NO: 677 - DNA, 437 bp, Adenovirus B35
  MISC_FEATURE (1)..(437): B35.orf00003 E4 ORF2 protein
atgacgcttgttttttttttatttttgcagactaattcaaaactaacaatgttggagcgcagcgcggtaacctattgcatttgcatcccagaggttttgaatgtttttttggcaaatttttcttttattcaatttctacaagaaactctgcctgattatatttccagcaacttcgatgatattactggtggttcccaatatgcttattccaatcttgtttttgctggagccaattggggaggtctgcgcttgtactgcactgtagcgtcccctgctcttgttcccggggggcttctggctaagcagtttggtgataatatgagagagtttttacaactagaacttaaagaagaacttagagccaagggcatgtcaattgatgttgccattctcaattcgctacaggtgacacaggagcaagatattttgtcattatg

SEQ ID NO: 678 - DNA, 354 bp, Adenovirus B35; identical to SEQ ID NO: 641
  MISC_FEATURE (1)..(354): B35.orf00004 E4 ORF3 protein

SEQ ID NO: 679 - DNA, 900 bp, Adenovirus B35
  MISC_FEATURE (1)..(900): B35.orf00007 E4 ORF6 protein
atgtcaggaagcaactccattatgacaaggttgcgcgcacgctcgacatcatgcgccagacatcacccttacaccagagcccagttaccacgttgtgaggaaaatgaaacccgagcttctatgactgaagaccacccgctgttgccagattgtgatactatgactatgcatagtgtaagttgtgttcgtggtcttccttgttctgccagctttactgttctgcaagagcttcctattccctgggatatgtttctaaatcctgaggagttaaaaattatgagaagatgcatgcatttatgtctatgttgtgccactatagatatttttcattctcaagtgattcacggtcgagagaattgggttcttcattgtcattgtaatcagcagggttcacttcaatgcatggctgggggagcggtgttggcagtgtggttccggaaggttatattgggttgcatgattaaccaacgttgtccatggtacagacagattgttaatatgcacatgccaaaagagatcatgtatgtgggtagtgtgtttttgagggaacgtcatttaatttatattaaactttggtatgatggtcatgcaggggcgattatatcagatatgagttttggctggagcgcttttaattatggtttattaaacaatattgtaataatgtgttgtacctactgcaaagatttgagtgaaatcagaatgcgttgctgcgcgcatcgcaccagaaagttgatgttaagggctattaaaatcatgcttcaggaaactgtggaccctgatcccataaacagcagtcgcacggagcgacgcagacagcggctgcttgtgggtttgatgagacacaatcgtccgataccgttttcggattatgattcccatcgttcttcttccagatga

SEQ ID NO: 680 - DNA, 252 bp, Adenovirus B35
  MISC_FEATURE (1)..(252): B35.orf00008 E4 ORF6/7 protein
atgaccgtgatccaaactccggagtcgcatccgcagcagttggactgtgaaagcgctttaaaagactatcgcgatggatttttatctatcactgaccccagattggctcgctctgaaactgtttggaatgtggaatctaaaacaatgtctatctctaatggtatccaaatgtttaaagctgtgcgtggggagagattggtgtattctgtcaaatgggaaggtggaggcaaaataactactcgaattttgtga

SEQ ID NO: 681 - DNA, 972 bp, Adenovirus B35; identical to SEQ ID NO: 141
  MISC_FEATURE (1)..(972): B35.orf00009 L5 fiber

SEQ ID NO: 682 - DNA, 165 bp, Adenovirus B35; identical to SEQ ID NO: 532
  MISC_FEATURE (1)..(165): B35.orf00010 U protein

SEQ ID NO: 683 - DNA, 408 bp, Adenovirus B35
  MISC_FEATURE (1)..(408): B35.orf00012 E3B 15.3K protein
atgactgaaacactcaccacctccaattccgccgaggatctgctcgatatggacggccgcgtctcagaacaacgacttgcccaactacgcatccgccagcagcaggaacgcgtggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccaacaaagtggagatactaagggttgcattcactgctcctgcgattccatcgagtgcacctacaccctgctgaagaccctatgcggcctaagagacctgctaccaatgaattaa

SEQ ID NO: 684 - DNA, 405 bp, Adenovirus B35
  MISC_FEATURE (1)..(405): B35.orf00013 E3B 15.2K protein
atgcaggctatactaccaatatttttgcttctattgcttccctacgctgtctcaaccccagctgcctatagtactccaccagaacaccttagaaaatgcaaattccaacaaccgtggtcatttcttgcttgctatcgagaaaaatcagaaatccccccaaatttaataatgattgctggaataattaatataatctgttgcaccataatttcatttttgatataccccctatttgattttggctggaatgctcccaatgcacatgatcatccacaagacccagaggaacacattcccccacaaaacatgcaacatccaatagcgctaatagattacgaaagtgaaccacaacccccactactccctgctattagttacttcaacctaaccggcggagatgactga

SEQ ID NO: 685 - DNA, 276 bp, Adenovirus B35
  MISC_FEATURE (1)..(276): B35.orf00014 E3B 10.3K protein
atggtacctagaaatttcttcttcaccatactcatctgtgcttttaatgtttgcgctactttcacagcagtagccacagcaaccccagactgtataggagcatttgcttcctatgcactttttgcttttgttacttgcatctgcgtatgtagcatagtctgcctggttattaattttttccaacttctagactggatccttgtgcgaattgcctacctgcgccaccatcccgaataccgcaaccaaaatatcgcggcacttcttagactcatctaa

SEQ ID NO: 686 - DNA, 564 bp, Adenovirus B35
  MISC_FEATURE (1)..(564): B35.orf00017 E3A 20.6K protein
atggtttccactaccacattccttatgcttactagtctcgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcatcatcgctgcagtgacaattggaatatctattcttgtttttaccataacctactacgcctgctgctatagaaaagacaaacataaaggtgatccattacttagatttgatatttaa

SEQ ID NO: 687 - DNA, 546 bp, Adenovirus B35
  MISC_FEATURE (1)..(456): B35.orf00018 E3A 20.3K protein
atggcttctcttacatctctcatatttgtcagcattgtcactgccgctcacggacaaacagtcgtctctatcccactaggacataattacactctcataggacccccaatcacttcagaggtcatctggaccaaactgggaagcgttgattactttgatataatctgtaacaaaacaaaaccaataatagtaacttgcaacatacaaaatcttacattgattaatgttagcaaagtttacagcggttactattatggttatgacagatacagtagtcaatatagaaattacttggttcgtgttacccagttgaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaa

SEQ ID NO: 688 - DNA, 501 bp, Adenovirus B35
  MISC_FEATURE (1)..(501): B35.orf00020 E3A 18.5K protein
atggggcccatactagtcttgcttgttttactttcgcttttggaaccgggttctgccaattacgatccatgtctagactttgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcctagcaaggacaacatcgtaacgttctccattgcttattgcttgtgcgcttgccttcttactgctttactgtgcgtatgcatacacctgcttgtaaccactcgcatcaaaaacgccaataacaaagaaaaaatgccttaa

SEQ ID NO: 689 - DNA, 396 bp, Adenovirus B35
  MISC_FEATURE (1)..(396): B35.orf00022 E3A 16.1K protein
atgaaagcctttgctgtcttatgtgtactgagtttaataaaaactgaattaagactctcctacggactgccgcttcttcaacccggattttacaaccagaagaacaaaacttttcctgtcgtccaggactctgttaacttcacctttcctactcacaaactagaagctcaacgactacaccgcttttccagaagcattttccctactaatactactttcaaaaccggaggtgagctccacggtctccctacagaaaacccttgggtggaagcgggccttgtagtactaggaattcttgcgggtgggcttgtgattattctttgctacctatacacaccttgcttcactttcctagtggtgttgtggtattggtttaaaaaatggggcccatactag

SEQ ID NO: 690 - DNA, 318 bp, Adenovirus B35
  MISC_FEATURE (1)..(318): B35.orf00023 E3A 12.1K protein
atgtctggtgacgcggctgagctatctcggctgcgacatctagaccactgccgccgctttcgctgctttgcccgggaacttattgagttcatctacttcgaactccccaaggatcaccctcaaggtccggcccacggagtgcggattactatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactga

SEQ ID NO: 691 - DNA, 684 bp, Adenovirus B35
  MISC_FEATURE (1)..(684): B35.orf00024 L4 protein VIII hexon associated protein
atgagtaaagaaattcccacgccttacatgtggagttatcaaccccaaatgggattggcagcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtagaggagtttactccctctgtctacttcaaccccttctccggatctcctgggcactacccggacgagttcataccgaacttcgacgcgattagcgagtcagtggacggctacgattga

SEQ ID NO: 692 - DNA, 255 bp, Adenovirus B35
  MISC_FEATURE (1)..(255): B35.orf00026 L4 33K protein
atggcatacagggttggaaagatccgatttcttaactctcgggtttgcgctggctcgttggctgtaatctttaatcctcctgttgctgcacttgttgtgtattttctaactgccgctgctggttttctgttggaggtcgccgccgctgtctttatctgtcgagactgtcgggatttgctggctatagtaggggctgtggaggtgacggtagtaatgcaaaacattgcgcggaaagttcaccccatggtggaatag

SEQ ID NO: 693 - DNA, 2439 bp, Adenovirus B35
  MISC_FEATURE (1)..(2439): B35.orf00028 L4 100K protein
atggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacagcgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagctgcgcctacgagcttaaccttttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcgtcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctccccgggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcacccttaagggggaagcccgccgtgattacatccgcgattgtgtctatctctacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgccactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcttgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtag

SEQ ID NO: 694 - DNA, 1557 bp, Adenovirus B35
  MISC_FEATURE (1)..(1557): B35.orf00029 E2A DNA binding protein
atggccagccgcgaaggaaatcagttaagcgaccgccacagggagcacacccccgaacgcggaaggggttctgccagtcatccgccttccaggtcggaccgcagcccttcgcaatcgcctccacctctgcccccgaagaaaaacacctgtcgccgtgtggggtcaggttcttctaccgacagtcagttggtaatggtgagcgaaacgtcacaatcctccctgtctccggaacggagcgacagtcctcctcctccgataccccccaaaaagaagccaaggaagaccaaacatatccccatgcaagacatcagtcaagacagcgaagaagaaagagaagaggcgcaacttgtagcagtgggtttcagctacccgcccgtgcgcatcgttgagaaggatggcaaaagaagcattgagaagatcgctaaagatgaccctctggctaaaggagctgctgcctgcactgttaagaatccgattagcttgcccctggtgtctgcttgggagaaaggcatggaagtgatgtgtctgctgatggagaagtacaggctggataacgaacttagaacctgttttaaactaatgcctgagcaacacgaacaatacaagcgcatctgtcaccagtacgtaaacgaagagcaccgaggcatccagttaactttcactagtcacaagacactgagcacgatgatgggaagatttctgcagggaatgatacattctttttctcagatcgcccaccataattgggaatgtacaggctgtgcgttgtggcctcatggctgcaatgattatgagggcaagctgaagtgcctgcatggcaatattatgattcagaaggagcagattatcgagatggatgtggccagcgagaacggacaacgagccttaaaggagaatcccgagcgaaccaaaatcacccaaaaccgctggggcagaagtgtggtgcaaatagccaacaatgacgcccgctgctgtgtgaatgatgccggctgtgcagctaaccagttttcgagcaggtcctgcgggatgttttataccgagggtagtaaagcccagcaggctttcaagcaatatgatgctttcatgagagccgtgtatccaggaatcagacaggatcaggccaagatgatactgatccccctgcactgcgattgcaaccacaagcctaattgggtgcccgccatgggtaggcagacctgcaagatgaccccgttcagcattgccaatgctgaagatctggatgtgggcatgattgcagatcccaccgtgctggcaagcgtgagacatccgtcgctgatggtgtttcagtgctgcaatccggtgtaccgcaactctcgcgctcagagcactggtcctaattgtgatttcaagatttcggctcctgacctgcttggagctttgcagctgaccagaaagctgtggagtgacatcctgcccgatataccggttcccaagttggtgattcccgaattcaagtggcaacccaagtatcagttccgcaacgtatcactgcctgcgggtcattctgattctcgtcagaacccattcgacttgtaa

SEQ ID NO: 695 - DNA, 630 bp, Adenovirus B35
  MISC_FEATURE (1)..(630): B35.orf00031 L3 23K proteinase
atggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggcccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctctcatcgtacacacatcgaaagggccactgcgttcgaccgtatggatgttcaataa

SEQ ID NO: 696 - DNA, 2859 bp, Adenovirus B35; identical to SEQ ID NO: 201
  MISC_FEATURE (1)..(2859): B35.orf00033 L3 hexon

SEQ ID NO: 697 - DNA, 741 bp, Adenovirus B35; identical to SEQ ID NO: 547
  MISC_FEATURE (1)..(741): B35.orf00036 L3 protein VI

SEQ ID NO: 698 - DNA, 231 bp, Adenovirus B35; identical to SEQ ID NO: 548
  MISC_FEATURE (1)..(231): B35.orf00037 L2 protein X

SEQ ID NO: 699 - DNA, 1056 bp, Adenovirus B35
  MISC_FEATURE (1)..(1056): B35.orf00038 L2 protein V
atgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcaatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaa

SEQ ID NO: 700 - DNA, 1698 bp, Adenovirus B35; identical to SEQ ID NO: 173
  MISC_FEATURE (1)..(1698): B35.orf00039 L2 penton

SEQ ID NO: 701 - DNA, 1593 bp, Adenovirus B35
  MISC_FEATURE (1)..(1593): B35.orf00042 L1 IIIa protein
atggaagctgtagtgccttcccgatctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctgttattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggtgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtacctaaacgattccttgctcagaccggcaagagaaaaaaatttcccaaacaatggaatagaaagtttggtggataaaatgagtagatggaagacttatgctcaggatcacagagacgagcctgggatcatggggactacaagtagagcgagccgtagacgccagcgccatgacagacagaggggtcttgtgtgggacgatgaggattcggccgatgatagcagcgtgttggacttgggtgggagaggaaggggcaacccgtttgctcatttgcgccctcgcttgggtggtatgttgtga

SEQ ID NO: 702 - DNA, 177 bp, Artificial Sequence; identical to SEQ ID NO: 552
  B35.orf00043 E2B 6.1 kDa hypothetical protein

SEQ ID NO: 703 - DNA, 1167 bp, Adenovirus B35
  MISC_FEATURE (1)..(1167): B35.orf00045 L1 55K protein
atgcatcccgtgctgcgacagatgcgcccccaacaacagcccccctcgcagcagcagcagcagcaaccacaaaaggctgtccctgcaactactgcaactgccgccgtgagcggtgcgggacagcccgcctatgatctggacttggaagagggcgaaggactggcacgtctaggtgcgccttcgcccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgagacgaggatttcgaagttgatgaagtgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtagctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactga

SEQ ID NO: 704 - DNA, 1917 bp, Adenovirus B35
  MISC_FEATURE (1)..(1917): B35.orf00047 E2B terminal protein
atgaactacttcatgccgctacgcaacatttggaaccgcgtacgcgagtttcctcgggcttctactaccgccgcaggaatcacctggatgtccaggtacatctacggctatcaccgccttatgttggaagacctcgcccctggcgctccagctacagaacgatggcctctctaccgccaaccaccgccgcattttcttatagggtaccagtatctggtgcgcacctgcaacgattacatctttgacacccgcgcctattcgcgccttaaatacaccgagctcgtgcgccctggtcaccagacagttaactggtcagtcatggccaactgtgcttacaccattaatacaggggcttaccaccgctttgtggattttgatgactttcaagccacccttacccaagtacagcaagccatcctcgccgaaagagtcgtagctgacttggcactggtacaaccaatgcgcggatttggactcacacgtatgcatggcagaacgggtgaggaagaagtgcccgtagaacggctcatgcaagactactacaaagatcttgctagatgtcaggataatgcttggggaatggccaatcgcctgcgtatccagcaagccggacccaaagacctggtgctcctcgccaccatccgccgtcttagaactgcctactttaatttcatcaccagcagcatcgtctcaccttcccgagatgaagaagaaacagaagacccagaccgaacacataaccacccccgcccacaagaagccgtactcagcctaccttgtgactgtgactggttagacgctttcgtcgaaaggttttcagatcccgtggatcttgacacgatcagatctctgcgcgcagtccctacgggccaattaataaaatgtataatcagcgccctctccctcccaaacggagaacctcccagtcaccactttaaggagatgcgcggcggtgtttttactctgcgaccgcgcgagaacggccgcgccgtcactgaaaccatgcgccgccgccgcggagaggtcattgaacgattcatcgaccgtttgcccgtgcgccgtcgacgtcgccgcgtgccccctccgcccccgcctgaagacgaagaagagatgttagtggaagaagagatagaagaggaagaagagatcccgggagccttcgaacgcgaagtacgggccaccatagccgaactcatccgtcttctcgaggaggaattgaccgtgtccgcgcgaaactcccagttttttaattttgccgtggacttctacgaggccatggagcgcttggaagctctgggcgatgttagcgaaatgccgctgagacgatggatcatgtatttcttcgtcgccgaacacattgccaccacactcaactacctttttcagcgcctatgcaactatgcggtcttcaccagacacgtggagcttaacctcgctcaggtggtgatgcgcgcaagagactccgagggggccgtggtttacagccgcgtctggaacgaggcgggcatgaatgcattctcccaactcatgggccgtatctccaatgacctcgcggccaccgtcgaaagagcgggtcgcggagatcttcaggaggaagaaatcgagcagttcatggcggagatcgcctaccaggacaactctggtgacgtacaagaaatactgagacaagctgccgttaacgataccgaaattgattctgttgaactctctttcaggttcaagctcacggggccggtagctttcacccagagacgtcagatacaagacgtcaatcgacgcgtggtggcgcacgcaagtcttctcagagcgcaataccagaacctgcccgtgcgcggcgccgacgtgccactaccagccatgcccccgggtccggaacaaccgctgccgcccggcgcgcgtccccgtcaccgcttctga

SEQ ID NO: 705 - DNA, 3369 bp, Adenovirus B35
  MISC_FEATURE (1)..(3369): B35.orf00048 E2B DNA polymerase
atgcaagaagcaagagagccaccaccgatcaaaagaaaaaacaaaggtacggtagtggcgcccaaaggacacggaaccctgcaagccattgacgtctctacaaacgaacctgtggaaatcaagtaccatctgaacctcccgcacgccctggaaaagatcatgcaagttaatcttctgtccctacctactaacctgagtccgcagcgtctcaggactctggacagctccagcctgcgcgctctcgtccttcagctccgcccctcccgcgccgaggtctggacttgcctcccgcgggggctcgtcagcatgaccaccatcgaaacagaagatgaacaggccgatacagcgaatatagaagagcacgagatacaatcgccaggcctcggcttcccactgaaatttctcgtcaagggaagccaggtacagctcattcacgagatacaacccgtgcaacgctgcgactactgcggccgtctgtacaagcacaaacacgaatgctcggcgcgccgcagaaacttctacttccatcacatcaacagccaatcctccaactggtggcaggaaatccagttcttcccgatcggctctcatcctcgcacagaaagactcttcctgacctacgatgtggaaacttacacctggatgggatcctttggcaaacaactagttcctttcatgctggtcatgaaactctcaggagaagagcgtctcgtcaacatggcccacgatctagccattaaactcaagtgggatcgatggcaacaagaccccagaaccttctactgtgtcactccagaaaaaatggcaattggccggcattttcgtcagtatcgggaccagttacaaacagcactggcggtagatctttggtcatcattcctacatgcaaatcctcacctgcacgaatgggctctcgaacactacgccttatctgaccccacagacctaacctttgatgagctcagtaagctacctcacgtcagaggcacgccgcgtttcatagaattatacatcgtaggacacaacatcaacggtttcgacgaaatcgtcctagctgcccaggtgatcaacaatcgagcggaagtaccacagcctttccgcatcactcgcaattttatgcccagagccggtaagattctcttcaatgatgttactttcgctttgcccaaccccgcctacaagaaacgggtagacttccaactctgggaacagggagcctgtgacgacatggacttcaaataccaatttctcaaagtcatggtcagagacacctttgcccttactcacgcttcgctacgaaaagctgctcaagcatactctctacccgtagagaagggctgctgcccttacaaggcagttaatcagttctacatgctaggatcttaccgtgcagacaaagacgggtttccgctagaagagtactggaaggatcgcgaagaataccttctcaaccgcgaactgtgggaaaagaaaaaccaaccaggttatgacatcattcaagaaacacttgactactgcgccctagacgtacttgtcaccgccgaactggtaaccaagcttcaagaatcttatgcccactttgtcagagactctgtaggtctacctcatgcccatttcaacatttttcaaagacccaccatctcttccaattctcacgccatctttcgccagatcgtctacagaacagaaaaacccaatcgcaccaacttgggtccggggctgctagcgccatcacatgaactatatgactatgtgcgagcaagtatcagaggggggcgatgctatccaacctacataggcatctttgaggatcccatctacgtctatgacatctgtggcatgtatgcctctgctctcacccatcccatgccctggggcagtccccttaacccatatgagcgcgcactggcagctcgagaatggcaaatggccttagatgaccccactcccatcagctattttgataaggatttacttccgggaatctttaccatggatgcagaccctcccgatgaacttatgctagacccacttccccctttctgttctaggaaaggaggtaggctctgttggaccaatgaaccccttcgaggcgaggtggccaccagtgtggatttaattaccttgcataatcgagggtggcaagtgagaatcgtgccagatgaattaacaactatcttccccgaatggaagtgcctggcacgcgagtatgtccaactcaacatcgccgccaaagagcgcgcggacaaggaaaagaaccaaaccatgcgatccattgccaaacttttatccaacgccctgtatggatcatttgccaccaaacttgacaataaaaaaattgtgttttctgaccaaatggacgaaaacctcatgaaaggcatctcaaccggcactgtcaatatcaaatcctcctcgttcttagaaactgacaacctgagtgcagaggtcatgcccgccttcgagagggaatacctaccccaacagctgacgttcctggacagcgatccggaagacagtgaggaagagcaaagaaccgcccccttttatacccccccagcggggaccccaggtcacgtgaaatacacctacaagccaatcacattcctggatgttgaagagggtgacatgtgtttgcatactttggaaaaggtggaccccctggttgacaacgatcgctacccctcccacatagcctcctttgtgctggcctggacgcgcgcctttgtatcagagtggtcagagttcctgtacgaagaagaccgaggcactccactggagaagaggcctgtaaaatcagtctacggagatacggacagcctgtttgtcactcaacgaggacacgaacttatggagaccaaaggtaagaaacgcatcaaaaaatatggcggaaaacttgtttttgaccccaatgaaccggatttaacctggctggtggaatgtgaaactgtttgcgcctcctgcggcgcggatgcatactccccagaatccattttccttgcgcccaagctgtatgcgctgaaatgcctatactgcccggtatgcaagaaaacttccaaaggtaagctccgcgccaaaggccacgcagccgaggcgctcaactacgaactcatggtaaactgctacttggccgacatacagggcgccaagcgacagaagttctccaccagcagaatgagtctgaagcgcaccctggcaagcgcccaagcaggcgcacaccccttcactgtgacggaaacaaccctgactcgaacactgagaccctggaaggaccgaaccctggcagcgctggacgcccatcgtctcataccctactccaggagccgtccaaacccgcgaaacgaggaggtctgctggatcgagatgccatag

SEQ ID NO: 706 - DNA, 1047 bp, Adenovirus B35
  MISC_FEATURE (1)..(1047): B35.orf00049 E2B protein IVa2
atgcccatggctgacggtctaaaaccgctgaaaaacttttcctcactacaagaacttctatcactaggaggagagcgcctcctaatggatttggtgcgggaaaatatgcatgtaagggaaatgatgaacgaggtggcccccttgcttcgagaagacggcagttgccgttccctaaactaccacctgcaacctgtaatcggaattatttatggccccaccggatgtggcaaatctcaattgctcagaaacttgctatcatcccaactaatcacccccgcccccgaaacggtgttcttcatagccccccaggtggacatgattccaccctcagaactgaaagcttgggaaatgcaaatctgtgaggggaactatgctccggggcccgaaggaacattcataccccaatctggtacgctccgccccaaattcattaaaatggcttatgatgatttaactcaggaacataactatgatgtgtcagacccacggaacgtgtttgcccgcgccgctgcccacggccccattgctattatcatggatgagtgcatggaaaatctcggaggacacaagggtgtctccaaatttttccacgcttttccatccaagctgcacgataaatttcctaaatgtaccggatacaccgtcttggtagtccttcataacatgaacccaagacgggatcttggcggcaatattgccaacttaaaaatccaatccaaaatgcacataatttcacctcgaatgcacccctcccagctcaaccggtttgtaaacacctacaccaagggcttatctgtggcaatcagcctacttctaaaagatattgtgcaacaccatgcactgcgaccttgttatgactgggtgatttacaacactaccccggagcatgaatcccttcaatggagctatctccaccccaaagacggcctaatgcccatgtatctaaacattcaatcccacctctataggattctggaaaaaatccaccgagttctcaatgatcgagatcggtggtccagggcataccgtgcgcgaaaaatgaaataa

SEQ ID NO: 707 - DNA, 330 bp, Adenovirus B35
  MISC_FEATURE (1)..(330): B35.orf00051 E1B hexon associated protein IX
atgggatctactgtggatggaagacccgttcaacccgccaattcttcaacgctgacctatgctactttaagttcttcacctttggacgcagctgcagccgctgccgccgcctctgtcgccgctaacactgtgcttggaatgggttactatggaagcatcgtggctaattccacttcctctaataacccttctacactgactcaggacaagttacttgtccttttggcccagctggaggctttgacccaacgtctgggtgaactttctcagcaggtggccgagttgcgagtacaaactgagtctgctgtcggcacggcaaagtctaaataa

SEQ ID NO: 708 - DNA, 1221 bp, Adenovirus B35
  MISC_FEATURE (1)..(1221): B35.orf00060 E1B 55K protein
gtgcttactggatctacgtccactggacgggataggggcgttaagagggagagggcatccagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagccagaggatgattgggaggtggccattaaaaattatgccaagatagctttgaggcctgataaacagtataagatcagtagacggattaatatccggaatgcttgttacatatctggaaatggggctgaggtggtaatagatactcaagacaagacagttattagatgctgcatgatggatatgtggcctggagtagtcggtatggaagcagtcacttttgtaaatgttaagtttaggggagatggttataatggaatagtgtttatggccaataccaaacttatattgcatggttgtagcttttttggtttcaacaatacctgtgtagatgcctggggacaggttagtgtacgggggtgtagtttctatgcgtgttggattgccacagctggcagaaccaagagtcaattgtctctgaagaaatgcatattccaaagatgtaacctgggcattctgaatgaaggcgaagcaagggtccgtcactgcgcttctacagatactggatgttttattttaattaagggaaatgccagcgtaaagcataacatgatttgtggtgcttccgatgagaggccttatcaaatgctcacttgtgctggtgggcattgtaatatgctggctactgtgcatattgtttcccatcaacgcaaaaaatggcctgtttttgatcacaatgtgttgaccaagtgcaccatgcatgcaggtgggcgtagaggaatgtttatgccttaccagtgtaacatgaatcatgtgaaagtgttgttggaaccagatgccttttccagaatgagcctaacaggaatctttgacatgaacacgcaaatctggaagatcctgaggtatgatgatacgagatcgagggtgcgcgcatgcgaatgcggaggcaagcatgccaggttccagccggtgtgtgtagatgtgaccgaagatctcagaccggatcatttggttattgcccgcactggagcagagttcggatccagtggagaagaaactgactaa

SEQ ID NO: 709 - DNA, 543 bp, Adenovirus B35
  MISC_FEATURE (1)..(543): B35.orf00061 E1B 21K protein
atggaggtttgggccattttggaagaccttaggaagactaggcaactgttagagagcgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtag

SEQ ID NO: 710 - DNA, 234 bp, Adenovirus B35
  MISC_FEATURE (1)..(234): B35.orf00063 E1A 25.7 kDa protein
gtgagttttgtgcttcttattataggtcctgtgtctgatgctgatgaatcaccatctcctgattctactacctcacctcctgatattcaagcacctgttcctgtggacgtgcgcaagcccattcctgtgaagcttaagcctgggaaacgtccagcagtggagaaacttgaggacttgttacagggtggggacggacctttggacttgagtacacggaaacgtccaagacaataa

SEQ ID NO: 711 - DNA, 840 bp, Adenovirus B35
  MISC_FEATURE (1)..(840): B35.orf00064 E1A 29.1 kDa protein
atgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcaatactccaggggtgattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaa

SEQ ID NO: 712 - DNA, 129 bp, Artificial Sequence
  B35.orf00065 hypothetical protein
atgcgtaacatttcccgcgacaacttgcaaaaaaactccacccccataaaacgtcattttcccacggccgcgccgccccttttaaccgttaaccccacagccaatcaccacacggcccacactttttaa

SEQ ID NO: 713 - DNA, 141 bp, Artificial Sequence
  C1.orf00001 hypothetical protein
atgggaagtgacgtatcgtgggaaaacggaagtgaagatttgaggaagttgtgggttttttggctttcgtttctgggcgtaggttcgcgtgcggttttctgggtgttttttgtggactttaaccgttacgtcattttttag

SEQ ID NO: 714 - DNA, 387 bp, Adenovirus C1
  MISC_FEATURE (1)..(387): C1.orf00002 E4 ORF1 protein
atggctgccgctgtggaagcgctgtatgttgttctggagcgggagggtgctattttgcctaggcaggagggtttttcaggtgtttatgtgtttttctctcctattaattttgttatacctcctatgggggctgtaatgttgtctctacgcctgcgggtatgtattcccccgggctatttcggtcgctttttagcactgaccgatgttaaccaacctgatgtgtttaccgagtcttacattatgactccggacatgaccgaggaactgtcggtggtgctttttaatcacggtgaccagtttttttacggtcacgccggcatggccgtagtccgtcttatgcttataagggttgtttttcctgttgtaagacaggcttctaatgtttaa

SEQ ID NO: 715 - DNA, 444 bp, Adenovirus C1
  MISC_FEATURE (1)..(444): C1.orf00005 E4 ORF2 protein
atgtttttttttttgttattttattttgtgtttatgcaggaacccgcagacatgtttgagagaaaaatggtgtctttttctgtggtggttccggaacttacctgcctttatctgcatgagcatgactacgatgtgcttgcttttttgcgcgaggctttgcctgattttttgagcagcaccttgcattttatatcgccgcccatgcaacaagcttacatcggggctacgctggttagcatagctccgagtatgcgtgtcataatcagtgtgggttcttttgtcatggttcctggcggggaagtggccgcgctggtccgtgcagacctgcacgattatgttcagctggccctgcgaagggacctacgggatcgcggtatttttgttaatgttccgcttttgaatcttatacaggtctgtgaggaacctgaatttttgcaatcatga

SEQ ID NO: 716 - DNA, 351 bp, Adenovirus C1
  MISC_FEATURE (1)..(351): C1.orf00006 E4 ORF3 protein
atgattcgctgcttgaggctgaaggtggagggtgctctggagcagatttttacaatggccggacttaatattcgggatttacttagagacatattgataaggtggcgagatgaaaattatttgggcatggttgaaggtgctggaatgtttatagaggagattcaccctgaagggtttagcctttacgtccacttggacgtgagggcagtttgccttttggaagccattgtgcaacatcttacaaatgccattatctgttctttggctgtagagtttgaccacgccaccggaggggagcgcgttcacttaatagatcttcattttgaggttttggataatcttttggaataa

SEQ ID NO: 717 - DNA, 885 bp, Adenovirus C1
  MISC_FEATURE (1)..(885): C1.orf00009 E4 34K E4 34K protein
atgactacgtccggcgttccatttggcatgacactacgaccaacacgatctcggttgtctcggcgcactccgtacagtagggatcgcctacctccttttgagacagagacccgcgctaccatactggaggatcatccgctgctgcccgaatgtaacactttgacaatgcacaacgtgagttacgtgcgaggtcttccctgcagtgtgggatttacgctgattcaggaatgggttgttccctgggatatggttctgacgcgggaggagcttgtaatcctgaggaagtgtatgcacgtgtgcctgtgttgtgccaacattgatatcatgacgagcatgatgatccatggttacgagtcctgggctctccactgtcattgttccagtcccggttccttgcagtgcatagccggcgggcaggttttggccagctggtttaggatggtggtggatggcgccatgtttaatcagaggtttatatggtaccgggaggtggtgaattacaacatgccaaaagaggtaatgtttatgtccagcgtgtttatgaggggtcgccacttaatctacctgcgcttgtggtatgatggccacgtgggttctgtggtccccgccatgagctttggatacagcgccttgcactgtgggattttgaacaatattgtggtgctgtgctgcagttactgtgctgatttaagtgagatcagggtgcgctgctgtgcccggaggacaaggcgtcttatgctgcgggcggtgcgaatcatcgctgaggagaccactgccatgttgtattcctgcaggacggagcggcggcggcagcagtttattcgcgcgctgctgcagcaccaccgccctatcctgatgcacgattatgactctacccccatgtag

SEQ ID NO: 718 - DNA, 225 bp, Adenovirus C1
  MISC_FEATURE (1)..(225): C1.orf00010 E4 ORF6/7 protein
gtggctcagcagctggacagcaacatgaacttaagagagctgcccggggagtttattaatatcactgatgagcgtttggctcgacaggaaaccgtgtggaatataacacctaagaatatgtctgttacccatgatatgatgctttttaaggccagccggggagaaaggactgtgtactctgtgtgttgggagggaggtggcaggttgaatactagggttctgtga

SEQ ID NO: 719 - DNA, 168 bp, Adenovirus C1
  MISC_FEATURE (1)..(168): C1.orf00011 U protein
atgaaaatagtgggtgcggaggggcaggaacaagaggaatctgacatcccatttaaactgtggagaaagtttgcagctagaagacgactgaggtaccagagttgggaggagggaaaggaggtgctgctgaataaattggataaagatctgctaagtgattttaagtaa

SEQ ID NO: 720 - DNA, 1749 bp, Adenovirus C1; identical to SEQ ID NO: 142
  MISC_FEATURE (1)..(1749): C1.orf00012 L5 fiber protein 62 kDa

SEQ ID NO: 721 - DNA, 387 bp, Adenovirus C1
  MISC_FEATURE (1)..(387): C1.orf00013 E3 control protein 14.7 kDa
atgactgacggcctagatctagaaatggacggaattattaccgagcagcgtctgctacagaggcgcaaagcagcggcagagcaggaacgcctaaatcaggagctccaagacatggttaacctgcaccagtgtaaaagaggtattttttgtctggttaagcaggcaaaagttacctacgagaaggaccacagcaaccaccgccttagctacaagctgcccgccaagcgccaaaaactgctgcttatggtgggagaaaggcccatcaccgtcactcagcagtcagtagaaactgagggctgtctgcacttcccctgccagggtccagaggacctttgcacccttattaagactttatgcggtcttagagatcttattccctttaactaa

SEQ ID NO: 722 - DNA, 402 bp, Adenovirus C1
  MISC_FEATURE (1)..(402): C1.orf00014 E3 14.9 kDa protein
atgaaaattacttggattttcttactaattttttacaccttaactgtggtttgctcccagacctccaagcctccccaaagacatgtatcttgcagatttactcgtatatggaacattccaagttgctacactgaaaaaagcgacctgtccgaaacctggttgtatgccatcatctcggtttttgtattttgtagcaccataattgcactagccatatacccctacctggatattggatggaacgccatagacgccatgagccattccactttccccgcgcccgctataattcagatgcagccaattgttgccggcggcattgtcccagccaatcagcatcgccctccttctcccactcccactgagattagctactttaatctaacaggcggagatgactga

SEQ ID NO: 723 - DNA, 276 bp, Adenovirus C1
  MISC_FEATURE (1)..(276): C1.orf00015 E3 RID-alpha
atgattcctcgagtttttatattattgacccttattgcgcttttctgcgcgtgctccacattggccgcggttgctaacatcgaagtagactgcattccagccttcacagtctacctgctttacggatttgtcacccttacgctcatctgcagcctcatcactgtagtgatcgcctttattcaatgcattgactgggtctgtgtgcgcattgcataccttagacaccatcctcaatacagagacacggccatagctgagcttcttagaattctttaa

SEQ ID NO: 724 - DNA, 417 bp, Adenovirus C1
  MISC_FEATURE (1)..(417): C1.orf00016 E3 10.7 kDa protein
atgtgccaggttggcaaggcaagacacacgcctacaaccttaaagtcaggctttcctggactgagagcgcctgacttcaacagcacctgccccgtggagttcatccagcaacttcagcagcccgccttcgacatggtcgacacagtgaactcttacaacaccgctaccggactcacatctacccaagatatgccccaagtttctacctttgttaataattgggcaaacttgggcatgtggtggttttcaatagcgcttatgtttgtctgccttattattatgtggctttcctgctgcctaaagcgcaaacgcgcccgaccacccatttataagcccattattgtgcttaacccaaacaatgatggaatacatagattggacgggctgaacacttgttctttttcttttgcagtatga

SEQ ID NO: 725 - DNA, 123 bp, Artificial Sequence
  C1.orf00017 hypothetical protein
atgtcttgcaacgcccccctcaaagctccccactttaccctgcttaatgtcattcccatggacaatggactctgtggaatatgtgccaggttggcaaggcaagacacacgcctacaaccttaa

SEQ ID NO: 726 - DNA, 483 bp, Adenovirus C1
  MISC_FEATURE (1)..(483): C1.orf00021 E3 glycosylated membrane protein 18.6 kDa
atgattaaatacatcattttaagcttgcttaccctagcggcagtctgcagtgctgccaaacaggtagagtttaaggagccagcttgcaatgttacatttaaatccgaagctaatgaatgcaccactcttataaaatgcaccacagaacatgaaaagcttattattcgccacaaagacaaagctggcaagtatgctgtatatgctatttggcagcctggagaccctaacaactataatgttacagtttttcagggtaatgattctaaagtttttttgtatgaatttccattttatgaaatgtgtgacattaccatgtacatgagcaaacagtataagttgtggcccccacaaaagtgtgtggagaacactggcactttttgctttactgctctcctgattacagtgattactttggtgtgtaccctcctttatattaaatttaaaagcagacgcagctttattgaagaaaagaaaatgccttag

SEQ ID NO: 727 - DNA, 129 bp, Adenovirus C1
  MISC_FEATURE (1)..(129): C1.orf00022 E3 CR1-alpha1
atgttggttaacaatcaggcggtgggtgcggcgaccggtgacgcactggtacgttcccggcaggtaaggagggtgattttttctgataagcccggagaggttgtccgcggctcactccgtcttggttga

SEQ ID NO: 728 - DNA, 324 bp, Adenovirus C1
  MISC_FEATURE (1)..(324): C1.orf00024 E3A 12 kDa protein
atgactagtggagaggcagagcaactgcgcctaacacaccttgaccactgccgccgccacaagtgctttgcccgcggctccggtgagttttgttactttgagttgcccgaagagcatatcgagggcccggcgcacggcgtccggctcaccacccaggtagagcttactcgtagcctaattcgggagtttaccctgcgccccctgctagtggagcgggagaggggtccctgtgttctgaccgtggtttgcaactgtcctaaccctggattacatcaagatctttgttgccatctctgtactgagtataataaatacagaaattag

SEQ ID NO: 729 - DNA, 684 bp, Adenovirus C1
  MISC_FEATURE (1)..(684): C1.orf00025 L4 VIII capsid protein
atgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctcgcttggtctccgtccggacgggacatttcagatcggcggtgccggccgctcttcatttacgccccgtcaggcgatcttaactctgcaaacctcatcctcggagccgcgctccggaggcattggaactctacaatttattgaggagttcgtgccttcggtttacttcaaccccttttctggacctcctggccactacccggaccagtttattcccaactttgacgcggtgaaggactcggcggacggctacgactga

SEQ ID NO: 730 - DNA, 465 bp, Adenovirus C1
  MISC_FEATURE (1)..(465): C1.orf00027 E2a_2 virion morphogenesis-associated protein 25 kDa
gtgggggcaacatctccttcgcccgccgctttcttctctaccatcacggcgtggccttcccccgtaacatcctgcattactaccgtcatctctacagcccctactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctaaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactag

SEQ ID NO: 731 - DNA, 2424 bp, Adenovirus C1
  MISC_FEATURE (1)..(2424): C1.orf00029 L5 hexon assembly-associated protein 90 kDa
atggagtcagtcgagaaggaggacagcctaaccgccccctctgagttcgccaccaccgcctccaccgatgccgccaacgcgcctaccaccttccccgtcgaggcacccccgcttgaggaggaggaagtgactatcgagcaggacccaggttttgtaagcgaagacgacgaggaccgctcagtaccaacagaggataaaaagcaagaccaggacgacgcagaggcaaacaaggagcaagtcgggcggggggacgagaggcatggcgactacctagatgtgggagacgacgtgctgttgaagcatctgcagcgccagtgcgctattatctgcgacgcgttgcaagagcgcagcgatgtgcccctcgccatagcggatgttagccttgcctacgaacgccacctgttctcaccgcgtgtaccccccaaacgacaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcattgtggagtgctggtggaacttgagggtgacaacgcgcgcctagccgtgctaaaacgcagcatcgaggtcacccactttgcctacccggcacttaacctaccccccaaggttatgagcacagtcatgagcgagctgattgtgcgccgtgcacaacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttactgacccgaagatgcagcgcaagctagaggaaacattgcactacacctttcgccagggctacgtgcgccaggcctgcaaaatttccaacgtggagctctgcaacctggtctcctaccttggaattttgcacgaaaaccgcctcgggcaaaacgtgcttcattccacgctcaagggcgaggcgcgccgcgactacgtccgcgactgcgtttacttatttctatgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaatcctgcccgccacctgctgtgcgcttcctagcgactttgtgcccattaagtaccgtgaatgccctccgccgctttggggtcactgctaccttctgcagctagccaactaccttgcctaccactccgacatcatggaagacgtgagcggtgacggcctactggagtgtcactgtcgctgcaacctatgcaccccgcaccgctccctggtctgcaattcgcagctgcttagcgagagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcccaatgcggagcttaccgcctgcgtcattacccagggccacatccttggccaattgcaagccatcaacaaagcccgccaagagtttctgctacgaaagggacggggggtttacttggacccccagtccggcgaggagctcaacccaattcccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggccgaagaggtgtcagacgaaacaccgtcaccctcggtcgcattcccctcgccggcgccccagaaatcggcaaccggtccaagcatggctacaacctccgctcctcaggcgccgccggcactgcccgttcgccgacccaaccgtag

SEQ ID NO: 732 - DNA, 1590 bp, Adenovirus C1
  MISC_FEATURE (1)..(1590): C1.orf00030 E2a_1 DNA-binding protein 59 kDa
atggccagtcgggaagaggagcagcgcgaaaccacccccgagcgcggacgcggtgcggcgcgacgtccaccaaccatggaggacgtgtcgtccccgtcgccgtcgccgccgcctccccgcgcgcccccaaaaaagcggctgaggcggcgtctcgagtccgaggacgaagaagactcgtcacaagacgcgctggtgccgcgcacacccagcccgcggccatcaacctcggcggcggatttggccaacgcgcccaagaagaaaaagaagcgcccatctcccaagcccgagcgcccgccatccccagaggtgattgtggacagcgaggaagaaagagaagatgtggcgctacaaatggtgggtttcagcaacccaccggtgctaattaagcacggcaagggaggtaagcgcacggtgcggcggctgaatgaagacgacccagtggcgcggggtatgcggatgcaagaggaagaggaagagcccagcgaagcggaaagtgaaagcacggtaatgaacccgctgagtctgccgatcgtgtctgcgtgggagaagggcatggaggctgcgcgcgcgctgatggacaagtatcacgtggataacgatctaaaggcgaacttcaagctactgcctgaccaagtggaagccctggcggccgtatgtaagacctggctgaacgaggagcaccgcgggttgcagctgacctttaccagcaacaagacctttgtgacgatgatggggcgattcctgcaagcgtacctgcagtcgtttgcagaggtgacctacaagcaccacgagcccacgggctgcgcgttgtggctgcaccgctgcgctgagatcgaaggcgagcttaagtgtctacacgggagcattatgataaacaaggagcacgtgattgaaatggatgtgacgagcgaaaacgggcagcgcgcgctgaaggagcagtctagcaaggccaagattgtgaagaaccgttggggccgaagcgtggtacagatctccaacaccgacgcgaggtgctgcgtgcacgacgcggcctgtccggcgaatcagttttccggcaagtcttgcggcatgtttttttccgaaggcgcaaaggcccaggtggcttttaagcagatccaggcctttatgaaggcgctgtatcctaacgcccagaccgggcacggtcaccttctgatgccactacggtgcgagtgcaactcaaagcctgggcatgcaccctttttgggaaggcagctaccaaagttgactccgttcgccctgagcaacgcggaggacctggacgcggatctgatctccgacaagagcgtgctggccagcgtgcatcacccggcgctgatagtgttccagtgctgcaaccctgtgtatcgcaactcgcgcgcgcagggcggaggccccaactgcgacttcaagatatcggggcccgacctgctaaacgcgttggtgatggtgcgcagcctgtggagtgaaaacttcaccgagctgccgcggatggttgtgcctgagtttaagtggagcactaaacaccagtatcgcaacgtgtccctgccagtggcgcatagcgatgcgcggcagaacccctttgatttttaa

SEQ ID NO: 733 - DNA, 615 bp, Adenovirus C1
  MISC_FEATURE (1)..(615): C1.orf00033 L3 protease
atgggctccagtgagcaggaactaaaagccattgtcaaagatcttggttgtggaccatattttttgggcacctatgacaagcgcttcccaggctttgtttccccacacaagctcgcctgcgccatagttaacacggccggtcgcgagactgggggtgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattacaggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaa

SEQ ID NO: 734 - DNA, 2880 bp, Adenovirus C1; identical to SEQ ID NO: 202
  MISC_FEATURE (1)..(2880): C1.orf00035 L4 hexon protein 109 kDa

SEQ ID NO: 735 - DNA, 753 bp, Adenovirus C1
  MISC_FEATURE (1)..(753): C1.orf00036 pVI hexon-associated protein 27 kDa
atggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccaaatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgttgccagatgggcgtggcgaaaagcgcccgcgccccgacagggaagagactctggtgacacaaatcgacgagcctccctcgtacgaggaggcgctaaagcaaggcctgcccaccacccgtcccatcgcgcccatggctaccggagtgttgggccagcacacacctgtaacgctggacctgcctccccccgctgacacccagcagaaacctgtgctgccagggccgtccgccgttgttgtaacccgccctagccgcgcgtccctgcgccgtgccgccagcggtccgcgatcgttgcggcccgtagccagtggcaactggcaaagcacactgaacagcatcgtgggtctgggggtgcaatccctaaagcgccgacgatgcttttga

SEQ ID NO: 736 - DNA, 243 bp, Adenovirus C1
  MISC_FEATURE (1)..(243): C1.orf00039 L2 X core protein
atggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactga

SEQ ID NO: 737 - DNA, 1140 bp, Adenovirus C1
  MISC_FEATURE (1)..(1140): C1.orf00042 pV minor core protein 42 kDa
atgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgttgcacgcgaccgcgcccaggcggcgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcgcccaccgtgcagctcatggtgcccaagcgccaacgactggaagatgtcttggaaaaaatgaccgtggagcctgggctggagcccgaggtccgcgtgcgaccaatcaagcaggtggcaccgggactgggcgtgcagaccgtggacgttcagatacccaccaccagtagcactagtattgccactgccacagagggcatggagacacaaacgtccccggtcgcctcggcggtggcagatgccgcggtgcaggcggccgctgcggccgcgtccaaaacctctacggaggtgcaaacggacccgtggatgtttcgcgtttcagccccccggcgtccgcgccgttcgaggaagtacggcgccgccagcgcgctactgcccgaatatgccctacatccttccatcgcgcctacccccggctatcgtggctacacctaccgccccagaagacgagcaactacccgacgccgaatcaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaa

SEQ ID NO: 738 - DNA, 597 bp, Adenovirus C1
  MISC_FEATURE (1)..(597): C1.orf00043 L2 VII core protein
atgtccatccttatatcgcccagcaataacacaggctggggcctgcgtttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgctatgactcagggtcgcaggggcaacgtgtactgggtgcgcgactcggttagcggcctgcgcgtgcccgtgcgcacccgccccccgcgcaactag

SEQ ID NO: 739 - DNA, 1725 bp, Adenovirus C1; identical to SEQ ID NO: 174
  MISC_FEATURE (1)..(1725): C1.orf00046 L3_1 penton protein 64 kDa

SEQ ID NO: 740 - DNA, 1758 bp, Adenovirus C1
  MISC_FEATURE (1)..(1758): C1.orf00047 L1 IIIa capsid protein
atgatgcaagacgcaacggacccggcggtgcgggcggcgctgcagagccagccgtccggccttaactccacggacgactggcgccaggtcatggaccgcatcatgtcgctgactgcgcgcaaccctgacgcgttccggcagcagccacaggccaaccggctctccgcaattctggaagcggtggtcccggcgcgcgcaaaccccacgcacgagaaggtgctggcgatcgtaaacgcgctggccgaaaacagggccatccggcccgatgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtccgggccagactattttttccagaccagtagacaaggcctgcagaccgtaaacctgagccaggctttcaagaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgagaggccataggtcaggcgcatgtggacgagcatactttccaggagattacaagtgttagccgcgcgctggggcaggaggacacgggcagcctggaggcaaccctgaactacctgctgaccaaccggcggcagaagatcccctcgttgcacagtttaaacagcgaggaggagcgcattttgcgctatgtgcagcagagcgtgagccttaacctgatgcgcgacggggtaacgcccagcgtggcgctggacatgaccgcgcgcaacatggaaccgggcatgtatgcctcaaaccggccgtttatcaatcgcctaatggactacttgcatcgcgcggccgccgtgaaccccgagtatttcaccaatgccatcttgaacccgcactggctaccgccccctggtttctacaccgggggatttgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctaggcgaggaggagtacctaaacaactcgttgctgcagccgcagcgcgaaaagaacctgcctccggcgtttcccaacaacgggatagagagcctagtggacaagatgagtagatggaagacgtatgcgcaggagcacagggatgtgcccggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaa

SEQ ID NO: 741 - DNA, 1248 bp, Adenovirus C1
  MISC_FEATURE (1)..(1248): C1.orf00049 L1 52 kDa protein
atgcatccggtgctgcggcagatgcgcccccctcctcagcagcggcaagagcaagagcagcggcagacatgcagggcaccctccccttctcctaccgcgtcaggaggggcaacatccgcggctgacgcggcggcagatggtgattacgaacccccgcggcgccgggcccggcactacctggacttggaggagggcgagggcctggcgcggctaggagcgccctctcctgagcgacacccaagggtgcagctgaagcgtgacacgcgcgaggcgtacgtgccgcggcagaacctgtttcgtgaccgcgagggagaggagcccgaggagatgcgggatcgaaagttccatgcagggcgcgagttgcggcatggcctgaaccgcgagcggttgctgcgcgaggaggactttgagcccgacgcgcggaccgggattagtcccgcgcgcgcacacgtggcggccgccgacctggtaaccgcgtacgagcagacggtgaaccaggagattaactttcaaaaaagctttaacaaccacgtgcgcacgcttgtagcgcgcgaggaggtggctataggactgatgcatctgtgggactttgtaagcgcgctggagcaaaacccaaatagcaagccgctcatggcgcagttgtttcttatagtgcagcacagcagggacaacgaggcattcagggatgcgctgttaaacatagtagagcccgagggccgctggctgctcgatttgataaatattctgcagagcatagtggtgcaggagcgcagcttgagcctggctgacaaggtggccgccattaactattccatgctcagtctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaa

SEQ ID NO: 742 - DNA, 282 bp, Artificial Sequence
  C1.orf00050 hypothetical protein
atgctttcgctttccagcctaaccgcttacgccgcgcgcggccagtggccaaaaaaagctagcgcagcagccgccgcgcctggaaggaagccaaaaggagcgctcccccgttgtctgacgtcgcacacctgggttcgacacgcgggcggtaaccgcatggatcacggcggacggccggatacggggctcgaaccccggtcgtccgccatgatacccttgcgaatttatccaccagaccacggaagagtgcccgcttacaggctctccttttgcacggtctag

SEQ ID NO: 743 - DNA, 150 bp, Adenovirus C1
  MISC_FEATURE (1)..(150): C1.orf00051 E2B DNA terminal protein
atgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcagtcgttgacgctctag

SEQ ID NO: 744 - DNA, 1839 bp, Adenovirus C1
  MISC_FEATURE (1)..(1839): C1.orf00053 E2B DNA terminal protein
atgttggaagacctcgcccccggagccccggccaccctacgctggcccctctaccgccagccgccgccgcactttttggtaggataccagtacctcgtgcggacttgcaacgactacgtctttgactcaagggcttactcgcgtctcagatacaccgagctctcgcagccgggccaccagaccgttaactggtccgttatggccaactgcacttacaccatcaacacgggcgcataccaccgctttgttgacatggatgacttccagtctaccctcacgcaggtgcagcaggccatattagccgagcgcgttgtcgccgacctggccctgcttcagccaatgaggggcttcggggtcacacgcatgggaggaagagggcgccacctacggccaaactccgccgccgccgcagcgatagatgcaagagatgcaggacaagaggaaggagaagaagaagtgccggtagaaaggctcatgcaagactactacaaagacctgcgccgatgtcaaaacgaagcctggggcatggccgaccgcctgcgcattcagcaggccggacccaaggacatggtgcttctgtcgaccatccgccgtctcaagaccgcctactttaattacatcatcagcagcacctccgccagaaacaaccccgaccgccgcccgctgccgcccgccacggtgctcagcctaccttgcgactgtgactggttagacgcctttctcgagaggttttccgatccggtcgatgcggactcgctcaggtccctcggtggcggagtacctacacaacaattgttgagatgcatcgttagcgccgtatccctgccgcacggcagccccccgccaacccataaccgggacatgacgggcggcgtcttccaactgcgcccccgcgagaacggccgcgccgtcaccgagaccatgcgccgtcgccgcggggagatgatcgagcgctttgtcgaccgcctcccggtgcgccgtcgtcgccgccgtgtcccccctcccccaccgccgccagaagaagaagaaggggaggcccttatggaagaggagattgaagaagaagaggcccctgtagcctttgagcgcgaggtgcgcgacactgtcgccgagctcatccgtcttctggaggaggagttaaccgtgtcggcgcgcaactcccagtttttcaacttcgccgtggacttctacgaggccatggagcgccttgaggccttgggggatatcaacgaatccacgttgcgacgctgggttatgtacttcttcgtggcagaacacaccgccaccaccctcaactacctctttcagcgcctgcgaaactacgccgtcttcgcccggcacgtggagctcaatctcgcgcaggtggtcatgcgcgcccgcgatgccgaagggggcgtggtctacagccgcgtctggaacgagggaggcctcaacgccttctcgcagctcatggcccgcatctccaacgacctcgccgccaccgtggagcgagccggacgcggagatctccaggaggaagagatcgagcagttcatggccgagatcgcctatcaagacaactcaggagacgtgcaggagattttgcgccaggccgccgtcaacgacaccgaaattgattctgtcgaactctctttcaggttcaagctcaccgggcccgtcgtcttcacgcagaggcgccagattcaggagatcaaccgccgcgtcgtcgcgttcgccagcaacctccgtgcgcagcaccagctcctgcccgcgcgcggcgccgacgtgcccctgccccctctcccggcgggtcccgagccccccctacctccgggggcccgcccgcgtcaccgcttttag

SEQ ID NO: 745 - DNA, 3309 bp, Adenovirus C1
  MISC_FEATURE (1)..(3309): C1.orf00055 E2B DNA polymerase
ttgcaagccatcgacgccgccaccaaccagcccctggaaatcaggtatcacctggacctagcccgcgccctgacccggctatgcgaggtaaacctgcaggagctcccgcctgacctgacgccgcgggagctccagaccatggacagctcccatttgcgcgatgttgtcatcaagctccgaccgccgcgcgcggacatctggactttgggctcgcgcggcgtggtggtccgatccaccgtaactcccctcgagcagccagacggtcaaggacaagcagccgaagtagaagaccaccagccaaacccgccaggcgaggggctcaaattcccactctgcttccttgtgcgcggtcgtcaggtcaacctcgtgcaggatgtacagcccgtgcaccgctgccagtactgcgcacgtttttacaaaagccagcacgagtgttcggcccgtcgcagggacttctactttcaccacatcaacagccactcctccaactggtggcgggagatccagttcttcccgatcggctcgcatcctcgcaccgagcgtctctttgtcacctacgatgtagagacctatacttggatgggggcctttgggaagcagctcgtgcccttcatgctggtcatgaaattcggcggagatgagcctctagtgaccgccgcgcgagacctagccgtggaccttggatgggaccgctgggaacaagacccgcttaccttctactgcatcaccccagaaaaaatggccgtaggtcgccagtttaggacctttcgcgaccatctgcaaatgctaatggcccgtgacctgtggagctcattcgttgcttccaaccctcatcttgcagactgggccctgtcagagcacgggctcaactcccctgaagagcttacctacgaagaacttaaaaaattgccctccattaagggcaccccgcgcttcttggaactttacatcgtgggccacaacatcaacggctttgacgagatcgtgctcgccgcccaggtaattaacaaccgttccgaggtgccgggacccttccgcatcacacgcaattttatgcctcgcgcgggaaagatactcttcaacgatgtcaccttcgccctaccaaacccgcgttccaaaaagcgcacggactttttgctctgggagcagggcggatgcgacgacactgacttcaaataccagtacctcaaagtcatggtcagggacacctttgcgctcacccacacctcgctccggaaggccgcgcaggcatacgcgctacccgtagaaaagggatgctgcgcctaccaggccgtcaaccagttctacatgctaggctcttaccgttcggaggccgacgggtttccgatccaagagtactggaaagaccgcgaagagtttgtcctcaaccgcgagctgtggaaaaaaaagggacaggataagtatgacatcatcaaggaaaccctggactactgtgccctagacgtgcaggtcaccgccgagctggtcaacaagctgcgcgactcctacgcctccttcgtgcgtgatgcggtaggtcttacagacgccagcttcaacgtcttccagcgtccaaccatatcatcgaactcgcatgccatcttcaggcagatcgtcttccgagcagagcagcccgcccgtagcaacctcggtcccgaactcctcgccccctcgcacgaactatacgattacgtgcgcgccagcatccgcggtggaagatgctaccctacatatcttggaatactcagggagcccctctacgtttacgacatctgcggcatgtacgcctccgcgctcacccaccccatgccatggggtcccccactcaacccatacgagcgcgcgcttgccgcccgcgcatggcagcaggcgttagacttgcaaggatgcaagatagactacttcgacgcgcgcctgttgcccgggatctttaccgtggacgcggaccccccggacgagacgcagctagaccccctaccgccattctgctcgcgcaagggcggccgcctctgctggaccaacgagcgcctacgcggagaggtagccaccagcgttgaccttgtcaccctgcacaaccgcggttggcgcgtgcacctggtgcccgacgagcgcaccaccgtctttcccgaatggcggtgcgttgcgcgcgaatacgtgcagctaaacatcgcggccaaggagcgcgccgatcgcgacaaaaaccaaaccctgcgctccatcgccaagttgctgtccaacgccctctacgggtcgtttgccaccaagcttgacaacaaaaagattgtcttttctgaccagatggacgcggccaccctcaaaggcatcaccgcgggccaggtgaatatcaaatcctcctcgtttttggaaactgacaaccttagcgcagaagtcatgcccgctttccagagggagtactcaccccaacagctggccctcgcagacagcgatgcggaagagagtgaggacgaacgcgcccccacccccttttatacccccccttcaggaacacccggtcacgtggcatacacctataaaccaatcaccttccttgatgccgaagagggggacatgtgtcttcacaccctggagcgagtggaccccctagtggacaacgaccgctacccctcccacttagcctccttcgtgctggcctggacgcgagccttcgtctcagagtggtccgagtttctatacgaggaggaccgcggaacaccgctcgaggacaggcctctcaagtctgtatacggggacacggacagccttttcgtcaccgagcgtggacaccggctcatggaaaccagaggtaagaaacgcatcaaaaagcatgggggaaacctggtttttgaccccgaacggccagagctcacctggctcgtggaatgcgagaccgtctgcggggcctgcggcgcggatgcctactccccggaatcggtatttctcgcgcccaagctctacgccctcaaaagtctgcactgcccctcgtgcggcgcctcctccaagggcaagctgcgcgccaagggccatgccgcggaggggctggactatgacaccatggtcaaatgctacctggccgacgcgcagggcgaagaccggcagcgcttcagcaccagcaggaccagcctcaagcgcaccctggccagcgcgcagcccggagcgcaccccttcaccgtgacccagactacgctgacgaggaccctgcgcccgtggaaagacatgaccctggcccgtctggacgagcaccgactactgccgtacagcgaaagccgccccaacccgcgaaacgaggagatatgctggatcgagatgccgtag

SEQ ID NO: 746 - DNA, 138 bp, Adenovirus C1
  MISC_FEATURE (1)..(138): C1.orf00056 IVa2 virion morphogenesis-associated protein 51 kDa
atgtccctgacacgcatgttttccctgaccaaatccgctagaaggcgctcgccgcccagcgatagcagttcttgcaaggaagcaaagtttttcaacggtttgaggccgtccgccgtaggcatgcttttgagcgtttga

SEQ ID NO: 747 - DNA, 945 bp, Adenovirus C1
  MISC_FEATURE (1)..(945): C1.orf00057 IVa2 virion morphogenesis-associated protein 51 kDa
atgcgtgtcagggacatgcttaacgaagtggcccccttgctcagggatgacggcagctgcagctctcttaactaccagttgcagccggtaataggtgtgatttacgggcccaccggctgcggtaagtcgcagctgctcaggaacctgctttcttcccagctgatctcccctaccccggaaaccgttttctttattgccccgcaggtagacatgatccccccatctgaactcaaagcgtgggaaatgcaaatctgtgagggtaactacgcccctgggccggatggaaccattataccgcagtctggcaccctccgcccgcgctttgtaaaaatggcctatgacgatctcatcctggaacacaactatgacgttagtgatcccagaaatatcttcgcccaggccgccgcccgtgggcccattgccatcattatggacgaatgcatggaaaatcttggaggtcacaagggcgtctccaagttcttccacgcatttccttctaagctacatgacaaatttcccaagtgcaccggatacactgtgctggtggttctgcacaacatgaatcccaggagggatatggctgggaacatagccaacctaaaaatacagtccaagatgcatctcatatccccacgtatgcacccatcccagcttaaccgctttgtaaacacttacaccaagggcctgcccctggcaatcagcttgcttctaaaggacatttttaggcaccacgcccagcgctcctgctacgactggatcatctacaacaccaccccgcagcatgaagctctgcagtggtgctacctccaccccagagacgggcttatgcccatgtatctgaacatccagagccatctctaccacgtcctggaaaaaatacacaggaccctcaacgaccgagaccgctggtcccgggcctaccgcgcgcgcaaaacccctaaataa

SEQ ID NO: 748 - DNA, 423 bp, Adenovirus C1
  MISC_FEATURE (1)..(423): C1.orf00059 IX hexon-associated protein 14.5 kDa
atgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggagctgcgccagcaggtttctgccctgaaggcttcctcccctcccaatgcggtttaa

SEQ ID NO: 749 - DNA, 1269 bp, Adenovirus C1
  MISC_FEATURE (1)..(1269): C1.orf00061 E1B transformation-associated protein 55 kDa
atgaatgttgtacaggtggctgaactgtttccagaactgagacgcattttaacaattaacgaggatgggcaggggctaaagggggtaaagagggagcggggggcttttgaggctacagaggaggttaggaatttaacttttagcttaatgaccagacaccgtcctgagtgtgttacttttcagcagattaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagattagcaaacttgtaaatattaggaattgttgctacatttctgggaacggggccgaggtggagatagatacggaggatagggtggcctttagatgtagcatgataaatatgtggccgggggtacttggcatggacggggtggttattatgaatgtgaggtttactggccccaattttagcggtacggttttcctggccaataccaaccttatcctacacggtgtaagcttctatgggtttaacaatacctgcgtggaagcctggaccgatgtaagggttcgaggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtgtgtggcaactgcgaggacagggcctctcagatgctaacctgctcggacggcaactgtcacctgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgaaagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattga

SEQ ID NO: 750 - DNA, 630 bp, Adenovirus C1
  MISC_FEATURE (1)..(630): C1.orf00062 E1A 21 kDa protein
atgtttaacttgcatggcgtgttaaatggggcggggcttaaagggtatataatgcgccgtgggctaatcttggttacatttgacctcatggaggcttgggagtgtttggaagatttttctgctgtgcgtaacttgctggaacagagctctaacagtacctcctggttttggaggtttctgtggggctcctcccaagcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatttgtggagagcggtggtgagacacaagaatcgcctactactgttgtcttccgtccgcccggcaataataccgacggaggagcagcagcagcaacagcagcagcaggaggaagccaggcggcggcggcggcaggagcagagcccatggaacccgagagccggcctggaccctcgggaatga

SEQ ID NO: 751 - DNA, 312 bp, Adenovirus C1
  MISC_FEATURE (1)..(312): C1.orf00063 E1A 26 kDa protein
gtgtctgaacctgagcctgagcccgagccagaaccggaacctgcaagacctgcccggcgtcctaaaatggtgcctgctatcctgagacgcccgacatcacctgtgtccagagaatgcaatagtagtacggatagctgtgactccggtccttctaacacacctcctgagatacatccggtggtcccgctgtgccccattaaaccagttgccgtgagagttggtgggcgtcgccgggctgtggaatgtatcgaggacttgcttaacgagcctgggcaacctttggacttgagctgtaaacgccccaggccataa

SEQ ID NO: 752 - DNA, 561 bp, Adenovirus C1
  MISC_FEATURE (1)..(561): C1.orf00064 E1A 32 kDa protein
atgagacatattatttgccacggaggtgttattaccgaagaaatggccgccagtcttttggaccagctaatcgaagaggtactggctgataatcttccacctcctagccattttgaaccacctacccttcacgaactgtatgatttagacgtgacggcccccgaagatcccaacgaggaggcggtttcgcagatttttcctgactctgtaatgttggcggcgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcagcccgggcacggttgcaggtcttgtcattatcatcggaggaatacgggggacccagatattatgtgttcgctttgctatatgaggacctgtggcatgtttgtctacagtaagtga

SEQ ID NO: 753 - DNA, 141 bp, Artificial Sequence; identical to SEQ ID NO: 713
  C2.orf00001 hypothetical protein

SEQ ID NO: 754 - DNA, 387 bp, Adenovirus C2; identical to SEQ ID NO: 714
  MISC_FEATURE (1)..(387): C2.orf00002 E4 ORF1 protein

SEQ ID NO: 755 - DNA, 411 bp, Adenovirus C2
  MISC_FEATURE (1)..(411): C2.orf00005 E4 ORF2 protein
atgcaggaacccgcagacatgtttgagagaaaaatggtgtctttttctgtggtggttccggaacttacctgcctttatctgcatgagcatgactacgatgtgcttgcttttttgcgcgaggctttgcctgattttttgagcagcaccttgcattttatatcgccgcccatgcaacaagcttacataggggctacgctggttagcatagctccgagtatgcgtgtcataatcagtgtgggttcttttgtcatggttcctggcggggaagtggccgcgctggtccgtgcagacctgcacgattatgttcagctggccctgcgaagggacctacgggatcgcggtatttttgttaatgttccgcttttgaatcttatacaggtctgtgaggaacctgaatttttgcaatcatga

SEQ ID NO: 756 - DNA, 351 bp, Adenovirus C2
  MISC_FEATURE (1)..(351): C2.orf00006 E4 ORF3 protein
atgattcgctgcttgaggctgaaggtggagggcgctctggagcagatttttacaatggccggacttaatattcgggatttgcttagagacatattgataaggtggcgagatgaaaattatttgggcatggttgaaggtgctggaatgtttatagaggagattcaccctgaagggtttagcctttacgtccacttggacgtgagggcagtttgccttttggaagccattgtgcaacatcttacaaatgccattatctgttctttggctgtagagtttgaccacgccaccggaggggagcgcgttcacttaatagatcttcattttgaggttttggataatcttttggaataa

SEQ ID NO: 757 - DNA, 885 bp, Adenovirus C2
  MISC_FEATURE (1)..(885): C2.orf00009 E4 34K E4 34K protein
atgactacgtccggcgttccatttggcatgacactacgaccaacacgatctcggttgtctcggcgcactccgtacagtagggatcgcctacctccttttgagacagagacccgcgctaccatactggaggatcatccgctgctgcccgaatgtaacactttgacaatgcacaacgtgagttacgtgcgaggtcttccctgcagtgtgggatttacgctgattcaggaatgggttgttccctgggatatggttctgacgcgggaggagcttgtaatcctgaggaagtgtatgcacgtgtgcctgtgttgtgccaacattgatatcatgacgagcatgatgatccatggttacgagtcctgggctctccactgtcattgttccagtcccggttccctgcagtgcatagccggcgggcaggttttggccagctggtttaggatggtggtggatggcgccatgtttaatcagaggtttatatggtaccgggaggtggtgaattacaacatgccaaaagaggtaatgtttatgtccagcgtgtttatgaggggtcgccacttaatctacctgcgcttgtggtatgatggccacgtgggttctgtggtccccgccatgagctttggatacagcgccttgcactgtgggattttgaacaatattgtggtgctgtgctgcagttactgtgctgatttaagtgagatcagggtgcgctgctgtgcccggaggacaaggcgtctcatgctgcgggcggtgcgaatcatcgctgaggagaccactgccatgttgtattcctgcaggacggagcggcggcggcagcagtttattcgcgcgctgctgcagcaccaccgccctatcctgatgcacgattatgactctacccccatgtag

SEQ ID NO: 758 - DNA, 201 bp, Adenovirus C2
  MISC_FEATURE (1)..(201): C2.orf00010 E4 ORF6/7 protein
atgaacttaagcgagctgcccggggagtttattaatatcactgatgagcgtttggctcgacaggaaaccgtgtggaatataacacctaagaatatgtctgttacccatgatatgatgctttttaaggccagccggggagaaaggactgtgtactctgtgtgttgggagggaggtggcaggttgaatactagggttctgtga

SEQ ID NO: 759 - DNA, 168 bp, Adenovirus C2
  MISC_FEATURE (1)..(168): C2.orf00011 U protein
atgaagatagtgggtgcggagggacaagaacatgaggaatttgacatcccatttaaactttggagaaagtttgcagctaaaaggcggctgagataccagagttgggaggaaggaaaggaggtgatgctgaataagctggacaaagatttgctgactgattttaagtaa

SEQ ID NO: 760 - DNA, 1749 bp, Adenovirus C2; identical to SEQ ID NO: 143
  MISC_FEATURE (1)..(1749): C2.orf00012 L5 fiber

SEQ ID NO: 761 - DNA, 387 bp, Adenovirus C2
  MISC_FEATURE (1)..(387): C2.orf00014 E3 control protein 14.7 kDa
atgactgaatctctagatctagaattggatggaattaacaccgaacagcgcctactagaaaggcgcaaggcggcgtccgagcgagaacgcctaaaacaagaagttgaagacatggttaacctacaccagtgtaaaagaggtatcttttgtgtggtcaagcaggccaaacttacctacgaaaaaaccactaccggcaaccgcctcagctacaagctacccacccagcgccaaaaactggtgcttatggtgggagaaaaacctatcaccgtcacccagcactcggcagaaacagagggctgcctgcacttcccctatcagggtccagaggacctctgcactcttattaaaaccatgtgtggtattagagatcttattccattcaactaa

SEQ ID NO: 762 - DNA, 393 bp, Adenovirus C2
  MISC_FEATURE (1)..(393): C2.orf00016 E3 RID-beta
atgaaacggagtgtcatttttgttttgctgattttttgcgccctacctgtgctttgctcccaaacctcagcgcctcccaaaagacatatttcctgcagattcactcaaatatggaacattcccagctgctacaacaaacagagcgatttgtcagaagcctggttatacgccatcatctctgtcatggttttttgcagtaccatttttgccctagccatatatccataccttgacattggctggaatgccatagatgccatgaaccaccctactttcccagtgcccgctgtcataccactgcaacaggttattgccccaatcaatcagcctcgccccccttctcccacccccactgagattagctactttaatttgacaggtggagatgactga

SEQ ID NO: 763 - DNA, 207 bp, Adenovirus C2
  MISC_FEATURE (1)..(207): C2.orf00017 E3 RID-alpha
atggtgcctgaggtacgcaatgcgcacacaaacccagtcaatgaactgaatgaaggcgatgactacagtgacgaggctgcagatgaggataagggtgacaaatccgtaaagcaggtaaactgtgaaaggtgggatgcaatctacttcgatgtgagcgaccgcggccaatgtagagcacgcacagaaaagcgcaacaagggtcaataa

SEQ ID NO: 764 - DNA, 162 bp, Adenovirus C2
  MISC_FEATURE (1)..(162): C2.orf00018 E3 CR1-beta
atgtttgtttgccttattattatgtggcttatttgttgcctaaagcgcagacgcgccagaccccccatctataggcctatcattgtgctcaacccacacaatgaaaaaattcatagattggacggtctgaaaccatgttctcttcttttacagtatgattaa

SEQ ID NO: 765 - DNA, 471 bp, Adenovirus C2
  MISC_FEATURE (1)..(471): C2.orf00020 19K protein
atgattttaggcttgctcgcccttgcggcagtctgcagcgctgccaaaaaggttgagtttaaggaaccagcttgcaatgttacatttaaatcagaagctaatgaatgcactactcttataaaatgcaccacagaacatgaaaagcttattattcgccacaaagacaaaattggcaagtatgctgtatatgctatttggcagccaggtgacactaacgactataatgtcacagtcttccaaggtgaaaatcgtaaaacttttatgtataaatttccattttatgaaatgtgcgatattaccatgtacatgagcaaacagtacaagttgtggcccccacaaaagtgtttagagaacactggcaccttttgttccaccgctctgcttattacagcgcttgctttggtatgtaccttactttatctcaaatacaaaagcagacgcagttttattgatgaaaagaaaatgccttga

SEQ ID NO: 766 - DNA, 120 bp, Adenovirus C2
  MISC_FEATURE (1)..(120): C2.orf00023 E3 CR1-alpha1
atgggagtaatgtctggttacgctcaggctgtaggtgtgggcgcagcaaccggtgacgcactcgtacgttcccggcaggtgaggagggtggtggtggtggtgtttttcttgacggtgtag

SEQ ID NO: 767 - DNA, 324 bp, Adenovirus C2
  MISC_FEATURE (1)..(324): C2.orf00025 E3 12.5 kDa immune modulating protein
atgaccagtggagaggcagagcgactgcgcctgacacacctcgaccactgccgccgccacaagtgctttgcccgcggctccggtgagttttgttactttgaattgcccgaagagcatatcgagggcccggcgcacggcgtccggctcaccacccaggtagagcttacacgtagcctgattcgggagtttaccaagcgccccctgctagtggagcgggagcggggtccctgtgttctgaccgtggtttgcaactgtcctaaccctggattacatcaagatctttgttgtcatctctgtgctgagtataataaatacagaaattag

SEQ ID NO: 768 - DNA, 171 bp, Adenovirus C2
  MISC_FEATURE (1)..(171): C2.orf00029 L4 encapsidation protein
atgacggtagtaatgcaggatgttacgggggaaggccacgccgtgatggtagagaagaaagcggcgggcgaaggagatgttgcccccacagtcttgcaagcaagcaactatggcgttcttgtgcccgcgccacgagcggtagccttggcgctgttgttgctcttgggctaa

SEQ ID NO: 769 - DNA, 2418 bp, Adenovirus C2
  MISC_FEATURE (1)..(2418): C2.orf00032 L4 hexon-assembly protein
atggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaggatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaaacgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgcctcgggcaaaacgtgcttcattccacgctcaagggcgaggcgcgccgcgactacgtccgcgactgcgtttacttatttctgtgctacacctggcaaacggccatgggcgtgtggcagcaatgcctggaggagcgcaacctaaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttctgcagctagccaactaccttgcctaccactccgacatcatggaagacgtgagcggtgacggcctactggagtgtcactgtcgctgcaacctatgcaccccgcaccgctccctggtctgcaattcgcaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccatcaacaaagcccgccaagagtttctgctacgaaagggacggggggtttacctggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaagcttccgaggccgaagaggtgtcagacgaaacaccgtcaccctcggtcgcattcccctcgccggcgccccagaaattggcaaccgttcccagcatcgctacaacctccgctcctcaggcgccgccggcactgcctgttcgccgacccaaccgtag

SEQ ID NO: 770 - DNA, 1590 bp, Adenovirus C2
  MISC_FEATURE (1)..(1590): C2.orf00033 E2A ssDNA-binding protein
atggccagtcgggaagaggagcagcgcgaaaccacccccgagcgcggacgcggtgcggcgcgacgtccaccaaccatggaggacgtgtcgtccccgtcgccgtcgccgccgcctccccgcgcgcccccaaaaaagcggctgaggcggcgtctcgagtccgaggacgaagaagactcgtcacaagatgcgctggtgccgcgcacacccagcccgcggccatcgacctcgacggcggatttggccattgcgtccaaaaagaaaaagaagcgcccctctcccaagcccgagcgcccgccatccccagaggtgatcgtggacagcgaggaagaaagagaagatgtggcgctacaaatggtgggtttcagcaacccaccggtgctaatcaagcacggcaagggaggtaagcgcacggtgcggcggctgaatgaagacgacccagtggcgcggggtatgcggacgcaagaggaaaaggaagagtccagtgaagcggaaagtgaaagcacggtgataaacccgctgagcctgccgatcgtgtctgcgtgggagaagggcatggaggctgcgcgcgcgttgatggacaagtaccacgtggataacgatctaaaggcaaacttcaagctactgcctgaccaagtggaagctctggcggccgtatgcaagacctggctaaacgaggagcaccgcgggttgcagctgaccttcaccagcaacaagacctttgtgacgatgatggggcgattcctgcaggcgtacctgcagtcgtttgcagaggtaacctacaagcaccacgagcccacgggctgcgcgttgtggctgcaccgctgcgctgagatcgaaggcgagcttaagtgtctacacgggagcattatgataaataaggagcacgtgattgaaatggatgtgacgagcgaaaacgggcagcgcgcgctgaaggagcagtctagcaaggccaagatcgtgaagaaccggtggggccgaaatgtggtgcagatctccaacaccgacgcaaggtgctgcgtgcatgacgcggcctgtccggccaatcagttttccggcaagtcttgcggcatgttcttctctgaaggcgcaaaggctcaggtggcttttaagcagatcaaggctttcatgcaggcgctgtatcctaacgcccagaccgggcacggtcaccttctgatgccactacggtgcgagtgcaactcaaagcctgggcatgcaccctttttgggaaggcagctaccaaagttgactccgttcgccctgagcaacgcggaggacctggacgcggatctgatctccgacaagagcgtgctggccagcgtgcaccacccggcgctgatagtgttccagtgctgcaaccctgtgtatcgcaactcgcgcgcgcagggcggaggccccaactgcgacttcaagatatcggcgcccgacctgctaaacgcgttggtgatggtgcgcagcctgtggagtgaaaacttcaccgagctgccgcggatggttgtgcctgagtttaagtggagcactaaacaccagtatcgcaacgtgtccctgccagtggcgcatagcgatgcgcggcagaacccctttgatttttaa

SEQ ID NO: 771 - DNA, 615 bp, Adenovirus C2
  MISC_FEATURE (1)..(615): C2.orf00035 L3 protease
atgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcgctcaaaaacatgctacctctttgagccctttggcttttctgaccaacgactcaagcaggtttaccagtttgagtacgagtcactcctgcgccgtagcgccattgcttcttcccccgaccgctgtataacgctggaaaagtccacccaaagcgtgcaggggcccaactcggccgcctgtggactattctgctgcatgtttctccacgcctttgccaactggccccaaactcccatggatcacaaccccaccatgaaccttattaccggggtacccaactccatgcttaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaa

SEQ ID NO: 772 - DNA, 2907 bp, Adenovirus C2; identical to SEQ ID NO: 203
  MISC_FEATURE (1)..(2907): C2.orf00041 L3 hexon

SEQ ID NO: 773 - DNA, 753 bp, Adenovirus C2
  MISC_FEATURE (1)..(753): C2.orf00043 L3 VI capsid protein
atggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccattaagaactatggcagcaaggcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcggcccgacagggaagaaactctggtgacgcaaatagatgagcctccctcgtacgaggaggcactaaagcaaggcctgcccaccacccgtcccatcgcgcccatggctaccggagtgctgggccagcacacacctgtaacgctggacctgcctccccccgctgacacccagcagaaacctgtgctgccagggccgtccgccgttgttgtaacccgccctagccgcgcgtccctgcgccgtgccgccagcggtccgcgatcgatgcggcccgtagccagtggcaactggcaaagcacactgaacagcatcgtgggtctgggggtgcaatccctgaagcgccgacgatgcttctaa

SEQ ID NO: 774 - DNA, 243 bp, Adenovirus C2; identical to SEQ ID NO: 736
  MISC_FEATURE (1)..(243): C2.orf00046 L2 X core protein

SEQ ID NO: 775 - DNA, 1107 bp, Adenovirus C2
  MISC_FEATURE (1)..(1107): C2.orf00048 L2 V core protein
atgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgcaaccgcgcccaggcggcgggtacagtggaaaggtcgacgcgtaagacgtgttttgcgacccggcaccaccgtagtttttacgcccggtgagcgctccacccgcacctacaagcgcgtgtatgatgaggtgtacggcgacgaggacctgcttgagcaggccaacgagcgcctcggggagtttgcctacggaaagcggcataaggacatgttggcgttgccgctggacgagggcaacccaacacctagcctaaagcccgtgacactgcagcaggtgctgcccacgcttgcaccgtccgaagaaaagcgcggcctaaagcgcgagtctggtgacttggcacccaccgtgcagctgatggtacccaagcgccagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaaaacctctacggaggtgcaaacggacccgtggatgtttcgcgtttcagccccccggcgcccgcgccgttccaggaagtacggcaccgccagcgcactactgcccgaatatgccctacatccttccatcgcgcctacccccggctatcgtggctacacctaccgccccagaagacgagcgactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaa

SEQ ID NO: 776 - DNA, 597 bp, Adenovirus C2
  MISC_FEATURE (1)..(597): C2.orf00049 L2 VII core protein
atgtccatccttatatcgcccagcaataacacaggctggggcctgcgcttcccaagcaagatgtttggcggggcaaagaagcgctccgaccaacacccagtgcgcgtgcgcgggcactaccgcgcgccctggggcgcgcacaaacgcggccgcactgggcgcaccaccgtcgatgacgccattgacgcggtggtggaggaggcgcgcaactacacgcccacgccgccaccagtgtccacagtggacgcggccattcagaccgtggtgcgcggagcccggcgttatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtactgggtgcgcgactcggttagcggcctgcgcgtgcccgtgcgcacccgccccccgcgcaactag

SEQ ID NO: 777 - DNA, 1716 bp, Adenovirus C2; identical to SEQ ID NO: 175
  MISC_FEATURE (1)..(1716): C2.orf00052 L2 penton

SEQ ID NO: 778 - DNA, 1758 bp, Adenovirus C2
  MISC_FEATURE (1)..(1758): C2.orf00057 L1 IIIa capsid protein
atgatgcaagacgcaacggacccggcggtgcgggcggcgctgcagagccagccgtccggccttaactccacggacgactggcgccaggtcatggaccgcatcatgtcgctgactgcgcgtaaccctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgatgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtccgggccagactattttttccagaccagtagacaaggcctgcagaccgtaaacctgagccaggctttcaagaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctgaactacctgctgaccaaccggcggcagaagatcccctcgttgcacagtttaaacagcgaggaggagcgcatcttgcgctatgtgcagcagagcgtgagccttaacctgatgcgcgacggggtaacgcccagcgtggcgctggacatgaccgcgcgcaacatggaaccgggcatgtatgcctcaaaccggccgtttatcaatcgcctaatggactacttgcatcgcgcggccgccgtgaaccccgagtatttcaccaatgccatcttgaacccgcactggctaccgccccctggtttctacaccgggggatttgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgcgagtagcccatttccaagcttgatagggtcttttaccagcactcgcaccacccgcccgcgcctgctgggcgaggaggagtacctaaacaactcgctgctgcagccgcagcgcgaaaagaacctgcctccggcatttcccaacaacgggatagagagcctagtggacaagatgagtagatggaagacgtatgcgcaggagcacagggatgtgcccggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaa

SEQ ID NO: 779 - DNA, 1248 bp, Adenovirus C2
  MISC_FEATURE (1)..(1248): C2.orf00059 L1 52 kDa protein
atgcatccggtgctgcggcagatgcgcccccctcctcagcagcggcaagagcaagagcagcggcagacatgcagggcaccctccccttctcctaccgcgtcaggaggggcaacatccgcggctgacgcggcggcagatggtgattacgaacccccgcggcgccgggcccggcactacctggacttggaggagggcgagggcctggcgcggctaggagcgccctctcctgagcgacacccaagggtgcagctgaagcgtgacacgcgcgaggcgtacgtgccgcggcagaacctgtttcgcgaccgcgagggagaggagcccgaggagatgcgggatcgaaagttccacgcagggcgcgagttgcggcatggcctgaaccgcgagcggttgctgcgcgaggaggactttgagcccgacgcgcggaccgggattagtcccgcgcgcgcacacgtggcggccgccgacctggtaaccgcgtacgagcagacggtgaaccaggagattaactttcaaaaaagctttaacaaccacgtgcgcacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacattctgcagagcatagtggtgcaggagcgcagcttgagcctggctgacaaggtggccgccattaactattccatgctcagtctgggcaagttttacgcccgcaagatataccataccccttacgttcccatagacaaggaggtaaagatcgaggggttctacatgcgcatggcgttgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaa

SEQ ID NO: 780 - DNA, 414 bp, Adenovirus C2
  MISC_FEATURE (1)..(414): C2.orf00063 E2B DNA terminal protein
atgatatccgtagatgtacctggacatccaggtgatgccggcggcggtggtggaggcgcgcggaaagtcgcggacgcggttccagatgttgcgcagcggcaaaaagtgctccatggtcgggacgctctggccggtgaggcgtgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggctgctgcgctagcttttttggccactggccgcgcgcggcgtaa

SEQ ID NO: 781 - DNA, 1842 bp, Adenovirus C2
  MISC_FEATURE (1)..(1842): C2.orf00065 pTP
atgttggaagacctcgcccccggagccccggccaccctacgctggcccctctaccgccagccgccgccgcactttttggtgggatatcagtacctggtgcggacttgcaacgactacgtctttgactcaagggcttactcgcgtctcaggtacaccgagctctcgcagccgggtcaccagaccgttaactggtccgttatggccaactgcacttacaccatcaacacgggcgcataccaccgctttgtggacatggatgacttccagtctaccctcacgcaggtgcagcaggccatattagccgagcgcgttgtcgccgacctggccctgcttcagccgatgaggggcttcggggtcacacgcatgggaggaagagggcgccacctacggccaaactccgccgccgccgtagcgatagatgcaagagatgcaggacaagaggaaggagaagaagaagtgccggtagaaaggctcatgcaagactactacaaagacctgcgccgatgtcaaaacgaagcctggggcatggccgaccgcctgcgcattcagcaggccggacccaaggacatggtgcttctgtcgaccatccgccgtctcaagaccgcctactttaattacatcatcagcagcacctccgccagaaacaaccccgaccgccacccgctgccgcccgccacggtgctcagcctaccttgcgactgtgactggttagacgcctttctcgagaggttttccgatccggtcgatgcggactcgctcaggtccctcggtggcggagtacctacacaacaattgttgagatgcatcgttagcgccgtatccctgccgcacggcagccccccgccaacccataaccgggacatgacgggcggcgtcttccaactgcgcccccgcgagaacggccgcgccgtcaccgagaccatgcgccgtcgccgcggggagatgatcgagcgctttgtcgaccgcctcccggtgcgccgtcgtcgccgccgtgtcccccctcccccaccgccgccagaagaagaagaagaaggggaggcccttatggaagaggagattgaagaagaagaggcccctgtagcctttgagcgcgaggtgcgcgacactgtcgccgagctcatccgtcttctggaggaggagttaaccgtgtcggcgcgcaactcccagtttttcaacttcgccgtggacttctacgaggccatggagcgccttgaggccttgggggatatcaacgaatccacgttgcgacgctgggttatgtacttcttcgtggcagaacacaccgccaccaccctcaactacctctttcagcgcctgcgaaactacgccgtcttcgcccggcacgtggagctcaatctcgcgcaggtggtcatgcgcgcccgcgatgccgaagggggcgtggtctacagccgcgtctggaacgagggaggcctcaacgccttctcgcagctcatggcccgcatctccaacgacctcgccgccaccgtggagcgagccggacgcggagatctccaggaggaagagatcgagcagttcatggccgaaatcgcctatcaagacaactcaggagacgtgcaggagattttgcgccaggccgccgtcaacgacaccgaaattgattctgtcgaactctctttcaggttcaagctcaccgggcccgtcgtcttcacgcagaggcgccagattcaggagatcaaccgccgcgtcgtcgcgttcgccagcaacctccgcgcgcagcaccagctcctgcccgcgcgcggcgccgacgtgcccctgccccctctcccggcgggtcccgagccccccctacctccgggggcccgcccgcgtcaccgcttttag

SEQ ID NO: 782 - DNA, 3309 bp, Adenovirus C2
  MISC_FEATURE (1)..(3309): C2.orf00067 E2B DNA polymerase
ttgcaagtcatcgacgccgccaccaaccagcccctggaaatcaggtatcacctggacctagcccgcgccctgacccggctatgcgaggtaaacctgcaggagctcccgcctgacctgtcgccgcgggagctccagaccatggacagctcccatctgcgcgatgttgtcatcaagctccgaccgccgcgcgcggacatctggactttgggctcgcgcggcgtggtggtccgatccaccataactcccctcgagcagccagacggtcaaggacaagcagccgaagtagaagaccaccagccaaacccgccaggcgaggggctcaaattcccactctgcttccttgtgcgcggtcgtcaggtcaacctcgtgcaggatgtacagcccgtgcaccgctgccagtactgcgcacgtttttacaaaagccagcacgagtgttcggcccgtcgcagggacttctactttcaccacatcaacagccactcctccaactggtggcgggagatccagttcttcccgatcggctcgcatcctcgcaccgagcgtctctttgtcacctacgatgtagagacctatacttggatgggggcctttgggaagcagctcgtgcccttcatgctggttatgaagttcggcggagatgagcctctggtgaccgccgcgcgagacctagccgtggaccttggatgggaccgctgggaacaagacccgcttaccttctactgcatcaccccagaaaaaatggccataggtcgccagtttaggacctttcgcgaccacctgcaaatgctaatggcccgtgacctgtggagctcattcgtcgcttccaaccctcatcttgcagactgggccctgtcagaacacgggctcagctcccctgaggagctcacctacgaggaacttaaaaaattgccctccatcaagggcaccccgcgcttcttggaactttacatcgtgggccacaacatcaacggcttcgacgagatcgtgctcgccgcccaggtaattaacaaccgttccgaggtgccgggacccttccgcatcacacgcaactttatgcctcgcgcgggaaagatacttttcaacgatgtcaccttcgccctgccaaacccgcgttccaaaaagcgcacggactttttgctctgggagcagggcggatgcgacgacactgacttcaaataccagtacctcaaagtcatggttagggacacctttgcgctcacccacacctcgctccggaaggccgcgcaggcatacgcgctacccgtagaaaagggatgctgcgcctaccaggccgtcaaccagttctacatgctaggctcttaccgttcggaggccgacgggtttccgatccaagagtactggaaagaccgcgaagagtttgtcctcaaccgcgagctgtggaaaaaaaagggacaggataagtatgacatcatcaaggaaaccctggactactgcgccctagacgtgcaggtcaccgccgagctggtcaacaagctgcgcgactcctacgcctccttcgtgcgtgacgcggtaggtctcacagacgccagcttcaacgtcttccagcgtccaaccatatcatccaactcacatgccatcttcaggcagatagtcttccgagcagagcagcccgcccgtagcaacctcggtcccgacctcctcgctccctcgcacgaactatacgattacgtgcgcgccagcatccgcggtggaagatgctaccctacatatcttggaatactcagagagcccctctacgtttacgacatttgcggcatgtacgcctccgcgctcacccaccccatgccatggggtcccccactcaacccatacgagcgcgcgcttgccgcccgcgcatggcagcaggcgctagacttgcaaggatgcaagatagactacttcgacgcgcgcctgctgcccggggtctttaccgtggacgcagaccccccggacgagacgcagctagacccactaccgccattctgttcgcgcaagggcggccgcctctgctggaccaacgagcgcctacgcggagaggtagccaccagcgttgaccttgtcaccctgcacaaccgcggttggcgcgtgcacctggtgcccgacgagcgcaccaccgtctttcccgaatggcggtgcgttgcgcgcgaatacgtgcagctaaacatcgcggccaaggagcgcgccgatcgcgacaaaaaccaaaccctgcgctccatcgccaagttgctgtccaacgccctctacgggtcgtttgccaccaagcttgacaacaaaaagattgtcttttctgaccagatggacgcggccaccctcaaaggcatcaccgcgggccaggtgaatatcaaatcctcctcgtttttggaaactgacaatcttagcgcagaagtcatgcccgcttttgagagggagtactcaccccaacagctggccctcgcagacagcgatgcggaagagagtgaggacgaacgcgcccccacccccttttatagccccccttcaggaacacccggtcacgtggcctacacctataaaccaatcaccttccttgatgccgaagagggcgacatgtgtcttcacaccctggagcgagtggaccccctagtggacaacgaccgctacccctcccacttagcctccttcgtgctggcctggacgcgagccttcgtctcagagtggtccgagtttctatacgaggaggaccgcggaacaccgctcgaggacaggcctctcaagtctgtatacggggacacggacagccttttcgtcaccgagcgtggacaccggctcatggaaaccagaggtaagaaacgcatcaaaaagcatgggggaaacctggtttttgaccccgaacggccagagctcacctggctcgtggaatgcgagaccgtctgcggggcctgcggcgcggatgcctactccccggaatcggtatttctcgcgcccaagctctacgcccttaaaagtctgcactgcccctcgtgcggcgcctcctccaagggcaagctgcgcgccaagggccacgccgcggaggggctggactatgacaccatggtcaaatgctacctggccgacgcgcagggcgaagaccggcagcgcttcagcaccagcaggaccagcctcaagcgcaccctggccagcgcgcagcccggagcgcaccccttcaccgtgacccagactacgctgacgaggaccctgcgcccgtggaaagacatgaccctggcccgtctggacgagcaccgactactgccgtacagcgaaagccgccccaacccgcgaaacgaggagatatgctggatcgagatgccgtag

SEQ ID NO: 783 - DNA, 1128 bp, Adenovirus C2
  MISC_FEATURE (1)..(1128): C2.orf00069 IVa2 pIVa2
atgctggatcgagatgccgtagagcacgtgaccgagctgtgggaccgcctggaactgcttggtcaaacgctcaaaagcatgcctacggcggacggcctcaaaccgttgaaaaactttgcttccttgcaagaactgctatcgctgggcggcgagcgccttctggcggatttggtcagggaaaacatgcaagtcagggacatgcttaacgaagtggcccccctgctcagggatgacggcagctgcagctctcttaactaccagttgcagccggtaataggtgtgatttacgggcccaccggctgcggtaagtcgcagctgctcaggaacctgctttcttcccagctgatctcccctaccccggaaacggttttcttcatcgccccgcaggtagacatgatccccccatctgaactcaaagcgtgggaaatgcaaatctgtgagggtaactacgcccctgggccggatggaaccattataccgcagtctggcaccctccgcccgcgctttgtaaaaatggcctatgacgatctcatcctggaacacaactatgacgttagtgatcccagaaatatcttcgcccaggccgccgcccgtgggcccattgccatcattatggacgaatgcatggaaaatcttggaggtcacaagggcgtctccaagttcttccacgcatttccttctaagctacatgacaaatttcccaagtgcaccggatacactgtgctggtggttctgcacaacatgaatccccggagggatatggctgggaacatagccaacctaaaaatacagtccaagatgcatctcatatccccacgtatgcacccatcccagcttaaccgctttgtaaacacttacaccaagggcctgcccctggcaatcagcttgctactgaaagacatttttaggcaccacgcccagcgctcctgctacgactggatcatctacaacaccaccccgcagcatgaagctctgcagtggtgctacctccaccccagagacgggcttatgcccatgtatctgaacatccagagtcacctttaccacgtcctggaaaaaatacacaggaccctcaacgaccgagaccgctggtcccgggcctaccgcgcgcgcaaaacccctaaataa

SEQ ID NO: 784 - DNA, 423 bp, Adenovirus C2
  MISC_FEATURE (1)..(423): C2.orf00071 pIX
atgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaa

SEQ ID NO: 785 - DNA, 1302 bp, Adenovirus C2
  MISC_FEATURE (1)..(1302): C2.orf00072 E1B large T antigen
atggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgcttcatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattga

SEQ ID NO: 786 - DNA, 528 bp, Adenovirus C2
  MISC_FEATURE (1)..(528): C2.orf00073 E1B 19K protein
atggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatga

SEQ ID NO: 787 - DNA, 312 bp, Adenovirus C2
  MISC_FEATURE (1)..(312): C2.orf00074 E1A 26 kDa protein
gtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataa

SEQ ID NO: 788 - DNA, 351 bp, Adenovirus C2
  MISC_FEATURE (1)..(351): C2.orf00076 E1A
atgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtga

SEQ ID NO: 789 - DNA, 141 bp, Artificial Sequence
  C5.orf00001 hypothetical protein
atgggaagtgacgtaacgtgggaaaacggaagtgacgatttgaggaagttgtgggttttttggctttcgtttctgggcgtaggttcgcgtgcggttttctgggtgttttttgtggactttaaccgttacgtcattttttag

SEQ ID NO: 790 - DNA, 387 bp, Adenovirus C5
  MISC_FEATURE (1)..(387): C5.orf00002 E4 ORF1 protein
atggctgccgctgtggaagcgctgtatgttgttctggagcgggagggtgctattttgcctaggcaggagggtttttcaggtgtttatgtgtttttctctcctattaattttgttatacctcctatgggggctgtaatgttgtctctacgcctgcgggtatgtattcccccgggctatttcggtcgctttttagcactgaccgatgtgaatcaacctgatgtgtttaccgagtcttacattatgactccggacatgaccgaggagctgtcggtggtgctttttaatcacggtgaccagtttttttacggtcacgccggcatggccgtagtccgtcttatgcttataagggttgtttttcctgttgtaagacaggcttctaatgtttaa

SEQ ID NO: 791 - DNA, 411 bp, Adenovirus C5
  MISC_FEATURE (1)..(411): C5.orf00004 E4 ORF2 protein
atgcagaaacccgcagacatgtttgagagaaaaatggtgtctttttctgtggtggttccggagcttacctgcctttatctgcatgagcatgactacgatgtgctttcttttttgcgcgaggctttgcctgattttttgagcagcaccttgcattttatatcgccgcccatgcaacaagcttacatcggggctacgctggttagcatagctccgagtatgcgtgtcataatcagtgtgggttcttttgtcatggttcctggcggggaagtggccgcgctggtccgtgcagacctgcacgattatgttcagctggccctgcgaagggacctacgggatcgcggtatttttgttaatgttccgcttttgaatcttatacaggtctgtgaggaacctgaatttttgcaatcatga

SEQ ID NO: 792 - DNA, 351 bp, Adenovirus C5
  MISC_FEATURE (1)..(351): C5.orf00005 E4 ORF3 protein
atgattcgctgcttgaggctgaaggtggagggcgctctggagcagatttttacaatggccggacttaatattcgggatttgcttagagatatattgagaaggtggcgagatgagaattatttgggcatggttgaaggtgctggaatgtttatagaggagattcaccctgaagggtttagcctttacgtccacttggacgtgagggccgtttgccttttggaagccattgtgcaacatcttacaaatgccattatctgttctttggctgtagagtttgaccacgccaccggaggggagcgcgttcacttaatagatcttcattttgaggttttggataatcttttggaataa

SEQ ID NO: 793 - DNA, 885 bp, Adenovirus C5
  MISC_FEATURE (1)..(885): C5.orf00007 E4 34K E4 34K protein
atgactacgtccggcgttccatttggcatgacactacgaccaacacgatctcggttgtctcggcgcactccgtacagtagggatcgtctacctccttttgagacagaaacccgcgctaccatactggaggatcatccgctgctgcccgaatgtaacactttgacaatgcacaacgtgagttacgtgcgaggtcttccctgcagtgtgggatttacgctgattcaggaatgggttgttccctgggatatggttctaacgcgggaggagcttgtaatcctgaggaagtgtatgcacgtgtgcctgtgttgtgccaacattgatatcatgacgagcatgatgatccatggttacgagtcctgggctctccactgtcattgttccagtcccggttccctgcagtgtatagccggcgggcaggttttggccagctggtttaggatggtggtggatggcgccatgtttaatcagaggtttatatggtaccgggaggtggtgaattacaacatgccaaaagaggtaatgtttatgtccagcgtgtttatgaggggtcgccacttaatctacctgcgcttgtggtatgatggccacgtgggttctgtggtccccgccatgagctttggatacagcgccttgcactgtgggattttgaacaatattgtggtgctgtgctgcagttactgtgctgatttaagtgagatcagggtgcgctgctgtgcccggaggacaaggcgccttatgctgcgggcggtgcgaatcatcgctgaggagaccactgccatgttgtattcctgcaggacggagcggcggcggcagcagtttattcgcgcgctgctgcagcaccaccgccctatcctgatgcacgattatgactctacccccatgtag

SEQ ID NO: 794 - DNA, 225 bp, Adenovirus C5
  MISC_FEATURE (1)..(225): C5.orf00008 E4 ORF6/7 protein
gtggctcagcagctggacagcgacatgaacttaagtgagctgcccggggagtttattaatatcactgatgagcgtttggctcgacaggaaaccgtgtggaatataacacctaagaatatgtctgttacccatgatatgatgctttttaaggccagccggggagaaaggactgtgtactctgtgtgttgggagggaggtggcaggttgaatactagggttctgtga

SEQ ID NO: 795 - DNA, 168 bp, Adenovirus C5
  MISC_FEATURE (1)..(168): C5.orf00009 U protein
atgaagatagtgggtgcggatggacaggaacaggaggaaactgacattccatttagattgtggagaaagtttgcagccaggaggaagctgcaataccagagctgggaggagggcaaggaggtgctgctgaataaactggacagaaatttgctaactgattttaagtaa

SEQ ID NO: 796 - DNA, 1746 bp, Adenovirus C5; identical to SEQ ID NO: 144
  MISC_FEATURE (1)..(1746): C5.orf00010 L5 fiber protein 62 kDa

SEQ ID NO: 797 - DNA, 387 bp, Adenovirus C5
  MISC_FEATURE (1)..(387): C5.orf00011 E3 control protein 14.7 kDa
atgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaa

SEQ ID NO: 798 - DNA, 399 bp, Adenovirus C5
  MISC_FEATURE (1)..(399): C5.orf00012 E3 14.9 kDa protein
atgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactga

SEQ ID NO: 799 - DNA, 213 bp, Adenovirus C5
  MISC_FEATURE (1)..(213): C5.orf00014 E3 RID-alpha
atggtgtctgagatatgcaaagcgcacacagacccagtcaatgcactggataaaggcgatgaccacagtgatgaggctgcagatgagcgtgagggtgacaaatccgtaaagcaaatagactgtgaaggctggaatgcagtctacttcgatgtgagaaaccgcagccaatgtggagcacgcacaaaaaaagcgcaacaagggtcagtaatataa

SEQ ID NO: 800 - DNA, 360 bp, Adenovirus C5
  MISC_FEATURE (1)..(360): C5.orf00015 E3 10.7 kDa protein
atgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatga

SEQ ID NO: 801 - DNA, 483 bp, Adenovirus C5
  MISC_FEATURE (1)..(483): C5.orf00017 19K protein
atgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaa

SEQ ID NO: 802 - DNA, 114 bp, Adenovirus C5
  MISC_FEATURE (1)..(114): C5.orf00018 E3 CR1-alpha
gtgattctctttattcttatactaacgcttctctgcctaaggctcgccgcctgctgtgtgcacatttgcatttattgtcagctttttaaacgctggggtcgccacccaagatga

SEQ ID NO: 803 - DNA, 342 bp, Adenovirus C5
  MISC_FEATURE (1)..(342): C5.orf00020 E3 CR1-alpha1
gtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtga

SEQ ID NO: 804 - DNA, 324 bp, Adenovirus C5
  MISC_FEATURE (1)..(324): C5.orf00021 E3 12.5 kDa immune modulating protein
atgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaa

SEQ ID NO: 805 - DNA, 684 bp, Adenovirus C5
  MISC_FEATURE (1)..(684): C5.orf00022 L4 VIII capsid protein
atgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactga

SEQ ID NO: 806 - DNA, 465 bp, Adenovirus C5
  MISC_FEATURE (1)..(465): C5.orf00023 E2a_2 virion morphogenesis-associated protein 25 kDa
gtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactag

SEQ ID NO: 807 - DNA, 2424 bp, Adenovirus C5
  MISC_FEATURE (1)..(2424): C5.orf00027 L5 hexon assembly-associated protein 90 kDa
atggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtag

SEQ ID NO: 808 - DNA, 1590 bp, Adenovirus C5
  MISC_FEATURE (1)..(1590): C5.orf00028 E2A ssDNA-binding protein
atggccagtcgggaagaggagcagcgcgaaaccacccccgagcgcggacgcggtgcggcgcgacgtcccccaaccatggaggacgtgtcgtccccgtccccgtcgccgccgcctccccgggcgcccccaaaaaagcggatgaggcggcgtatcgagtccgaggacgaggaagactcatcacaagacgcgctggtgccgcgcacacccagcccgcggccatcgacctcggcggcggatttggccattgcgcccaagaagaaaaagaagcgcccttctcccaagcccgagcgcccgccatcaccagaggtaatcgtggacagcgaggaagaaagagaagatgtggcgctacaaatggtgggtttcagcaacccaccggtgctaatcaagcatggcaaaggaggtaagcgcacagtgcggcggctgaatgaagacgacccagtggcgcgtggtatgcggacgcaagaggaagaggaagagcccagcgaagcggaaagtgaaattacggtgatgaacccgctgagtgtgccgatcgtgtctgcgtgggagaagggcatggaggctgcgcgcgcgctgatggacaagtaccacgtggataacgatctaaaggcgaacttcaaactactgcctgaccaagtggaagctctggcggccgtatgcaagacctggctgaacgaggagcaccgcgggttgcagctgaccttcaccagcaacaagacctttgtgacgatgatggggcgattcctgcaggcgtacctgcagtcgtttgcagaggtgacctacaagcatcacgagcccacgggctgcgcgttgtggctgcaccgctgcgctgagatcgaaggcgagcttaagtgtctacacggaagcattatgataaataaggagcacgtgattgaaatggatgtgacgagcgaaaacgggcagcgcgcgctgaaggagcagtctagcaaggccaagatcgtgaagaaccggtggggccgaaatgtggtgcagatctccaacaccgacgcaaggtgctgcgtgcacgacgcggcctgtccggccaatcagttttccggcaagtcttgcggcatgttcttctctgaaggcgcaaaggctcaggtggcttttaagcagatcaaggcttttatgcaggcgctgtatcctaacgcccagaccgggcacggtcaccttttgatgccactacggtgcgagtgcaactcaaagcctgggcacgcgccctttttgggaaggcagctaccaaagttgactccgttcgccctgagcaacgcggaggacctggacgcggatctgatctccgacaagagcgtgctggccagcgtgcaccacccggcgctgatagtgttccagtgctgcaaccctgtgtatcgcaactcgcgcgcgcagggcggaggccccaactgcgacttcaagatatcggcgcccgacctgctaaacgcgttggtgatggtgcgcagcctgtggagtgaaaacttcaccgagctgccgcggatggttgtgcctgagtttaagtggagcactaaacaccagtatcgcaacgtgtccctgccagtggcgcatagcgatgcgcggcagaacccctttgatttttaa

SEQ ID NO: 809 - DNA, 615 bp, Adenovirus C5
  MISC_FEATURE (1)..(615): C5.orf00029 L3 protease
atgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaa

SEQ ID NO: 810 - DNA, 2859 bp, Adenovirus C5; identical to SEQ ID NO: 204
  MISC_FEATURE (1)..(2859): C5.orf00030 L3 hexon

SEQ ID NO: 811 - DNA, 753 bp, Adenovirus C5
  MISC_FEATURE (1)..(753): C5.orf00032 pVI hexon-associated protein 27 kDa
atggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctga

SEQ ID NO: 812 - DNA, 243 bp, Adenovirus C5; identical to SEQ ID NO: 736
  MISC_FEATURE (1)..(243): C5.orf00034 L2 X core protein

SEQ ID NO: 813 - DNA, 1140 bp, Adenovirus C5
  MISC_FEATURE (1)..(1140): C5.orf00035 pV minor core protein 42 kDa
atgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaa

SEQ ID NO: 814 - DNA, 597 bp, Adenovirus C5
  MISC_FEATURE (1)..(597): C5.orf00036 L2 VII core protein
atgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactag

SEQ ID NO: 815 - DNA, 1716 bp, Adenovirus C5
  MISC_FEATURE (1)..(1716): C5.orf00039 pIII
atgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttga

SEQ ID NO: 816 - DNA, 1758 bp, Adenovirus C5
  MISC_FEATURE (1)..(1758): C5.orf00040 L1 IIIa capsid protein
atgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaa

SEQ ID NO: 817 - DNA, 1248 bp, Adenovirus C5
  MISC_FEATURE (1)..(1248): C5.orf00041 L1 47 kDa protein
atgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaa

SEQ ID NO: 818 - DNA, 309 bp, Adenovirus C5
  MISC_FEATURE (1)..(309): C5.orf00044 E2B DNA terminal protein
gtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaa

SEQ ID NO: 819 - DNA, 1962 bp, Adenovirus C5
  MISC_FEATURE (1)..(1962): C5.orf00045 pTP
atggagcactttttgccgctgcgcaacatctggaaccgcgtccgcgactttccgcgcgcctccaccaccgccgccggcatcacctggatgtccaggtacatctacggatatcatcgccttatgttggaagatctcgcccccggagccccggccaccctacgctggcccctctaccgccagccgccgccgcactttttggtgggataccagtacctggtgcggacttgcaacgactacgtatttgactcgagggcttactcgcgtctcaggtacaccgagctctcgcagccgggtcaccagaccgttaactggtccgttatggccaactgcacttacaccatcaacacgggcgcataccaccgctttgtggacatggatgacttccagtctaccctcacgcaggtgcagcaggccatattagccgagcgcgttgtcgccgacctagccctgcttcagccgatgaggggcttcggggtcacacgcatgggaggaagagggcgccacctacggccaaactccgccgccgccgcagcgatagatgcaagagatgcaggacaagaggaaggagaagaagaagtgccggtagaaaggctcatgcaagactactacaaagacctgcgccgatgtcaaaacgaagcctggggcatggccgaccgcctgcgcattcagcaggccggacccaaggacatggtgcttctgtcgaccatccgccgtctcaagaccgcctactttaattacatcatcagcagcacctccgccagaaacaaccccgaccgccgcccgctgccgcccgccacggtgctcagcctaccttgcgactgtgactggttagacgcctttctcgagaggttttccgatccggtcgatgcggactcgctcaggtccctcggcggcggagtacctacacaacaattgttgagatgcatcgttagcgccgtatccctgccgcatggcagccccccgccaacccataaccgggacatgacgggcggcgtcttccaactgcgcccccgcgagaacggccgcgccgtcaccgagaccatgcgccgtcgccgcggggagatgatcgagcgctttgtcgaccgcctcccggtgcgccgtcgtcgccgccgtgtcccccctcccccaccgccgccagaagaagaagaaggggaggcccttatggaagaggagattgaagaagaagaagaggcccctgtagcctttgagcgcgaggtgcgcgacactgtcgccgagctcatccgtcttctggaggaggagttaaccgtgtcggcgcgcaactcccagtttttcaacttcgccgtggacttctacgaggccatggagcgccttgaggccttgggggatatcaacgaatccacgttgcgacgctgggttatgtacttcttcgtggcagaacacaccgccaccaccctcaactacctctttcagcgcctgcgaaactacgccgtcttcgcccggcacgtggagctcaatctcgcgcaggtggtcatgcgcgcccgcgatgccgaagggggcgtggtctacagccgcgtctggaacgagggaggcctcaacgccttctcgcagctcatggcccgcatttccaacgacctcgccgccaccgtggagcgagccggacgcggagatctccaggaggaagagatcgagcagttcatggccgagatcgcctatcaagacaactcaggagacgtgcaggagattttgcgccaggccgccgtcaacgacaccgaaattgattctgtcgaactctctttcaggttcaagctcaccgggcccgtcgtcttcacgcagaggcgccagattcaggagatcaaccgccgcgtcgtcgcgttcgccagcaacctacgcgcgcagcaccagctcctgcccgcgcgcggcgccgacgtgcccctgccccctctcccggcgggtccggagccccccctacctccgggggctcgcccgcgtcaccgcttttag

SEQ ID NO: 820 - DNA, 3309 bp, Adenovirus C5
  MISC_FEATURE (1)..(3309): C5.orf00046 E2B DNA polymerase
ttgcaagccatcgacgccgccaccaaccagcccctggaaattaggtatcacctggatctagcccgcgccctgacccgtctatgcgaggtaaacctgcaggagctcccgcctgacctgacgccgcgggagctccagaccatggacagctcccatctgcgcgatgttgtcatcaagctccgaccgccgcgcgcggacatctggactttgggctcgcgcggcgtggtggtccgatccaccgtaactcccctcgagcagccagacggtcaaggacaagcagccgaagtagaagaccaccagccaaacccgccaggcgaggggctcaaattcccactctgcttccttgtgcgcggtcgtcaggtcaacctcgtgcaggatgtacagcccgtgcaccgctgccagtactgcgcacgtttttacaaaagccagcacgagtgttcggcccgtcgcagggacttctactttcaccacatcaatagccactcctccaattggtggcgggagatccagttcttcccgatcggctcgcatcctcgcaccgagcgtctctttgtcacctacgatgtagagacctatacttggatgggggcctttgggaagcagctcgtgcccttcatgctggtcatgaagttcggcggagatgagcctctagtgactgccgcgcgagacctagccgcgaaccttggatgggaccgctgggaacaagacccgcttaccttctactgcatcaccccagaaaaaatggccataggtcgccagtttaggacctttcgcgaccacctgcaaatgctaatggcccgtgacctgtggagctcattcgtcgcttccaaccctcatcttgcagactgggccctttcagagcacgggctcagctcccctgaagagctcacctacgaggaacttaaaaaattgccttccatcaagggcatcccgcgcttcttggaactttacattgtgggccacaacatcaacggctttgacgagatcgtgctcgccgcccaggtaattaacaaccgttccgaggtgccgggacccttccgcatcacacgcaactttatgcctcgcgcgggaaagatactcttcaacgatgtcaccttcgccctgccaaatccgcgttccaaaaagcgcacggactttttgctctgggagcagggcggatgcgacgacactgacttcaaataccagtacctcaaagtcatggtcagggacacctttgcgctcacccacacctcgctccggaaggccgcgcaggcatacgcgctacccgtagaaaagggatgctgcgcctaccaggccgtcaaccagttctacatgctaggctcttaccgttcggaggccgacgggtttccgatccaagagtactggaaagaccgcgaagagtttgtcctcaaccgcgagctgtggaaaaaaaagggacaggataagtatgacatcatcaaggaaaccctggactactgcgccctagacgtgcaggtcaccgccgagctggtcaacaagctgcgcgactcctacgcctccttcgtgcgtgacgcggtaggtctcacagacgccagcttcaacgtcttccagcgtccaaccatatcatccaactcacatgccatcttcaggcagatagtcttccgagcagagcagcccgcccgtagcaacctcggtcccgacctcctcgctccctcgcacgaactatacgattacgtgcgcgccagcatccgcggtggaagatgctaccctacatatcttggaatactcagagagcccctctacgtttacgacatttgcggcatgtacgcctccgcgctcacccaccccatgccatggggtcccccactcaacccatacgagcgcgcgcttgccgcccgcgcatggcagcaggcgctagacttgcaaggatgcaagatagactacttcgacgcgcgcctgctgcccggggtctttaccgtggacgcagaccccccggacgagacgcagctagaccccctaccgccattctgctcgcgcaagggcggccgcctctgctggaccaacgagcgcctacgcggagaggtagccaccagcgttgaccttgtcaccctgcacaaccgcggttggcgcgtgcacctggtgcccgacgagcgcaccaccgtctttcccgaatggcggtgcgttgcgcgcgaatacgtgcagctaaacatcgcggccaaggagcgcgccgatcgcgacaaaaaccaaaccctgcgctccatcgccaagttgctgtccaacgccctctacgggtcgtttgccaccaagcttgacaacaaaaagattgtcttttctgaccagatggatgcggccaccctcaaaggcatcaccgcgggccaggtgaatatcaaatcctcctcgtttttggaaactgacaatcttagcgcagaagtcatgcccgcttttcagagggagtactcaccccaacagctggccctcgcagacagcgatgcggaagagagtgaggacgaacgcgcccccacccccttttatagccccccttcaggaacacccggtcacgtggcctacacctacaaaccaatcaccttccttgatgccgaagagggcgacatgtgtcttcacaccctggagcgagtggaccccctagtggacaacgaccgctacccctcccacttagcctccttcgtgctggcctggacgcgagcctttgtctcagagtggtccgagtttctatacgaggaggaccgcggaacaccgctcgaggacaggcctctcaagtctgtatacggggacacggacagccttttcgtcaccgagcgtggacaccggctcatggaaaccagaggtaagaaacgcatcaaaaagcatgggggaaacctggtttttgaccccgaacggccagagctcacctggctcgtggaatgcgagaccgtctgcggggcctgcggcgcggatgcctactccccggaatcggtatttctcgcgcccaagctctacgccctcaaaagtctgcactgcccctcgtgcggcgcctcctccaagggcaagctgcgcgccaagggccacgccgcggaggggctggactatgacaccatggtcaaatgctacctggccgacgcgcagggcgaagaccggcagcgcttcagcaccagcaggaccagcctcaagcgcaccctggccagcgcgcagcccggagcgcaccccttcaccgtgacccagactacgctgacgaggaccctgcgcccgtggaaagacatgaccctggcccgtctggacgagcaccgactactgccgtacagcgaaagccgccccaacccgcgaaacgaggagatatgctggatcgagatgccgtag

SEQ ID NO: 821 - DNA, 1128 bp, Adenovirus C5
  MISC_FEATURE (1)..(1128): C5.orf00047 IVa2 virion morphogenesis-associated protein 51 kDa
atgctggatcgagatgccgtagagcaggtgaccgagctgtgggaccgcctggaactgcttggtcaaacgctcaaaagcatgcctacggcggacggtctcaaaccgttgaaaaactttgcttccttgcaagaactgctatcgctgggcggcgagcgccttctggcggatttggtcagggaaaacatgcgagtcagggacatgcttaacgaagtggcccccctgctcagggatgacggcagctgcagctctcttaactaccagttgcagccggtaataggtgtgatttacgggcccaccggctgcggtaagtcgcagctgctcaggaacctgctttcttcccagctgatctcccctaccccggaaaccgttttcttcatcgccccgcaggtagacatgatccccccatctgaactcaaagcgtgggaaatgcaaatctgtgagggtaactacgcccctgggccggatggaaccattataccgcagtctggcaccctccgcccgcgctttgtaaaaatggcctatgacgatctcatcctggaacacaactatgacgttagtgatcccagaaatatcttcgcccaggccgccgcccgtgggcccattgccatcattatggacgaatgcatggaaaatcttggaggtcacaagggcgtctccaagttcttccacgcatttccttctaagctacatgacaaatttcccaagtgcaccggatacactgtgctggtggttctgcacaacatgaatccccggagggatatggctgggaacatagccaacctaaaaatacagtccaagatgcatctcatatccccacgtatgcacccatcccagcttaaccgctttgtaaacacttacaccaagggcctgcccctggcaatcagcttgctactgaaagacatttttaggcaccacgcccagcgctcctgctacgactggatcatctacaacaccaccccgcagcatgaagctctgcagtggtgctacctccaccccagagacgggcttatgcccatgtatctgaacatccagagtcacctttaccacgtcctggaaaaaatacacaggaccctcaacgaccgagaccgctggtcccgggcctaccgcgcgcgcaaaacccctaaataa

SEQ ID NO: 822 - DNA, 423 bp, Adenovirus C5
  MISC_FEATURE (1)..(423): C5.orf00050 IX hexon-associated protein 14.5 kDa
atgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaa

SEQ ID NO: 823 - DNA, 1491 bp, Adenovirus C5
  MISC_FEATURE (1)..(1491): C5.orf00052 E1B large T antigen
atggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattga

SEQ ID NO: 824 - DNA, 210 bp, Adenovirus C5
  MISC_FEATURE (1)..(210): C5.orf00053 E1B 19K protein
atgggtttcttcgctccatttatcctttataaaactcaaaaaagcaacagcagccgcagcgcgccccggtgtggaaaaatccaaagtcttgatgaccttctcttggaaaagcgcctggtgacccagattcaaagaatcaaacagctcaccacaggatttcaaaagctcttcaaattcccacttgtaatcctccttaattctgcagactaa

SEQ ID NO: 825 - DNA, 333 bp, Adenovirus C5
  MISC_FEATURE (1)..(333): C5.orf00055 E1A 26 kDa protein
gtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataa

SEQ ID NO: 826 - DNA, 519 bp, Adenovirus C5
  MISC_FEATURE (1)..(519): C5.orf00056 E1A
atggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtga

SEQ ID NO: 827 - DNA, 141 bp, Artificial Sequence
  C6.orf00001 hypothetical protein
atgggaagtgacgtatcgtgggaaaacggaagtgaagatttgaggaagttgtgggttttttggctttcgtttctgggcgtaggttcgcgtgcggttttctgggtggtttttgtggactttaaccgttacgtcattttttag

SEQ ID NO: 828 - DNA, 387 bp, Adenovirus C6; identical to SEQ ID NO: 714
  MISC_FEATURE (1)..(387): C6.orf00002 E4 ORF1 protein

SEQ ID NO: 829 - DNA, 411 bp, Adenovirus C6
  MISC_FEATURE (1)..(411): C6.orf00004 E4 ORF2 protein
atgcaggaacccgcagacatgtttgagagaaaaatggtgtctttttctgtggtggttccggaacttacctgcctttatctgcatgagcatgactacgatgtgcttgcttttttgcgcgaggctttgcctgattttttgagcagtaccttgcattttatatcgccgcccatgcaacaagcttacatcggggctacgctggttagcatagctccgagtatgcgtgtcataatcagtgtgggttcttttgtcatggttcctggcggggaagtggccgcgctggtccgtgcagacctgcacgattatgttcagctggccctgcgaagggacctacgggatcgcggtatttttgttaatgttccgcttttgaatcttatacaggtctgtgaggaacctgaatttttgcaatcatga

SEQ ID NO: 830 - DNA, 351 bp, Adenovirus C6; identical to SEQ ID NO: 756
  MISC_FEATURE (1)..(351): C6.orf00005 E4 ORF3 protein

SEQ ID NO: 831 - DNA, 885 bp, Adenovirus C6
  MISC_FEATURE (1)..(885): C6.orf00008 E4 34K E4 34K protein
atgactacgtccggcgttccatttggcatgacactacgaccaacacgatctcggttgtctcggcgcactccgtacagtagggatcgcctacctccttttgagacagagacacgcgctaccatactggaggatcatccgctgctgcccgaatgtaacactttgacaatgcacaacgtgagttacgtgcgaggtcttccctgcagtgtgggatttacgctgattcaggaatgggttgttccctgggatatggttctgacgcgggaggagcttgtaatcctgaggaagtgtatgcacgtgtgcctgtgttgtgccaacattgatatcatgacgagcatgatgatccatggttacgagtcctgggctctccactgtcattgttccagtcccggttccctgcagtgcatagccggcgggcaggttttggccagctggtttaggatggtggtggatggcgccatgtttaatcagaggtttatatggtaccgggaggtggtgaattacaacatgccaaaagaggtaatgtttatgtccagcgtgtttatgaggggtcgccacttaatctacctgcgcttgtggtatgatggccacgtgggttctgtggtccccgccatgagctttggatacagcgccttgcactgtgggattttaaacaatattgtggtactgtgctgcagttactgtgctgacttaagtgagatcagggtgcgctgctgtgcccggaggacaaggcgccttatgctgcgggcggtgcgaatcatcgctgaggagaccactgccatgttgtattcctgcaggacggagcggcggcggcagcagtttattcgcgcgctgctgcagcaccaccgccctatcctgatgcacgattatgactctacccccatgtag

SEQ ID NO: 832 - DNA, 225 bp, Adenovirus C6
  MISC_FEATURE (1)..(225): C6.orf00009 E4 ORF6/7 protein
gtggctcagcagctggacagcgacatgaacttaagcgagctgcccggggagtttattaacatcactgatgagcgtttggctcgacaggagaccgtgtggaatataacacctaagaatatgtctgttacccatgatatgatgctgtttaaggccagccggggagaaaggactgtgtactctgtgtgttgggagggaggtggcaggttgaatactagggttctgtga

SEQ ID NO: 833 - DNA, 168 bp, Adenovirus C6
  MISC_FEATURE (1)..(168): C6.orf00011 U protein
atgaagatagtgggtgcggagggacaagaacatgaggaatttgacatcccatttagactttggagaaagttcgcagctaaaaggctgctgaaataccagagttgggaggagggaaaggaggtgatgctgaataagctggacaaagatttgctgactgattttaagtaa

SEQ ID NO: 834 - DNA, 1587 bp, Adenovirus C6; identical to SEQ ID NO: 145
  MISC_FEATURE (1)..(1587): C6.orf00012 L5 fiber protein 62 kDa

SEQ ID NO: 835 - DNA, 387 bp, Adenovirus C6
  MISC_FEATURE (1)..(387): C6.orf00014 E3 control protein 14.7 kDa
atgactgaatctctagatctagaattggatggaattaacaccgaacagcgcctactagaaaggcgcaaggcggcgtccgagcgagaacgcctaaaacaagaagttgaagacatggttaacctgcaccagtgtaaaagaggtatcttttgtgtggtcaagcaggccaaacttacctacgaaaaaaccactaccggcaaccgccttagctacaagctacccacccagcgccaaaaactggtgcttatggtgggagaaaaacctatcaccgtcacccagcactcggcagaaacagaaggctgcctgcacttcccctatcagggtccagaggacctctgcactcttattaaaaccatgtgtggcattagagatcttattccattcaactaa

SEQ ID NO: 836 - DNA, 393 bp, Adenovirus C6
  MISC_FEATURE (1)..(393): C6.orf00016 E3 RID-beta
atgaaacggattgtcacttttgttttgctgattttctgcgccctacctgtgctttgctcccaaacctcagcgcctcccaaaagacatatttcctgcagattcactcaaatatggaacattcccagctgctacaacaaacagagcgatttgtcagaagcctggttatacgccatcatctctgtcatggttttttgcagtaccatttttgccctagccatatacccataccttgacattggttggaatgccatagatgccatgaaccaccctactttcccagcgcccaatgtcataccactgcaacaggttattgccccaatcaatcagcctcgccccccttctcccacccccactgagattagctactttaatttgacaggtggagatgactga

SEQ ID NO: 837 - DNA, 207 bp, Adenovirus C6
  MISC_FEATURE (1)..(207): C6.orf00017 E3 RID-alpha
atggtgcctaaggtacgcaatgcgcacacaaatccagtcaatgaactgaatgaaggcgatgactacagtgacgaggctgcagatgaggataagggtgacaaatccgtaaagcaggtaaactgtgaaaggtgggatgcaatctacttcgatgtgagcgaccgcagccaatgtagagcacgcacagaaaagcgcaacaagggtcaataa

SEQ ID NO: 838 - DNA, 306 bp, Adenovirus C6
  MISC_FEATURE (1)..(306): C6.orf00019 E3 CR1-beta
atgaccggctcaaccatcgcgcccacaacggactatcgcaacaccactgctaccggactaaaatctgccctaaatttaccccaagttcatgcctttgtcaatgactgggcgagcttgggcatgtggtggttttccatagcgcttatgtttgtttgccttattattatgtggcttatttgttgcctaaagcgcagacgcgccagaccccccatctataggcctatcattgtgctcaacccacacaatgaaaaaattcatagattggacggtctcaaaccatgttctcttcttttacagtatgattaa

SEQ ID NO: 839 - DNA, 480 bp, Adenovirus C6
  MISC_FEATURE (1)..(480): C6.orf00020 19K protein
atgaggtacatgattttaggcttgctcgcccttgcggcagtctgcagcgctgccaaaaaggttgagtttaaggaaccagcttgcaatgttacatttaaatcagaagctaatgaatgcactactcttataaaatgcaccacagaacatgaaaagcttattattcgccacaaagacaaaattggcaagtatgctgtatatgctatttggcagccaggtgacactaacgactataatgtcacagtcttccaaggtgaaaatcgtaaaacttttatgtataaatttccattttatgaaatgtgcgatattaccatgtacatgagcaaacagtacaagttgtggcccccacaaaagtgtttagagaacactggcaccttttgttccaccgctctgcttattacagcgcttgctttggtatgtaccttactttatctcaaatacaaaagcagacgcagttttattgatgaaaagaaaatgccttga

SEQ ID NO: 840 - DNA, 324 bp, Adenovirus C6
  MISC_FEATURE (1)..(324): C6.orf00023 E3 CR1-alpha
gtgctgagtataataaatacagaaattagaatctactggggctcctgtcgccatcctgtgaacgccaccgtttttacccacccaaagcagaccaaagcaaacctcacctccggtttgcacaagcgggccaataagtaccttacctggtactttaacggctcttcatttgtaatttacaacagtttccagcgagacgaagtaagtttgccacacaaccttctcggcttcaactacaccgtcaagaaaaacaccaccaccaccctcctcacctgccgggaacgtacgagtgcgtcaccggttgctgcgcccacacctacagcctga

SEQ ID NO: 841 - DNA, 324 bp, Adenovirus C6
  MISC_FEATURE (1)..(324): C6.orf00024 E3 12.5 kDa immune modulating protein
atgaccagtggagaggcagagcaactgcgcctgacacacctcgaccactgccgccgccacaagtgctttgcccgcggctccggtgagttttgttactttgaattgcccgaagagcatatcgagggcccggcgcacggcgtccggctcaccacccaggtagagcttacacgtagcctgattcgggagtttaccaagcgccccctgctagtggagcgggagcggggtccctgtgttctgaccgtggtttgcaactgtcctaaccctggattacatcaagatctttgttgtcatctctgtgctgagtataataaatacagaaattag

SEQ ID NO: 842 - DNA, 684 bp, Adenovirus C6
  MISC_FEATURE (1)..(684): C6.orf00025 L4 VIII capsid protein
atgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactga

SEQ ID NO: 843 - DNA, 123 bp, Adenovirus C6
  MISC_FEATURE (1)..(123): C6.orf00026 22K protein
gtgctcctcctcctgctgctgccgccgctgtggatttcttgggctttgtcagagtcttgctatccggtcgcctttgcttctgcgtggccgctgctgttgctgccgctgccgccggtgcagtag

SEQ ID NO: 844 - DNA, 171 bp, Adenovirus C6
  MISC_FEATURE (1)..(171): C6.orf00028 22K protein
atgacggtagtaatgcaggatgttacgggggaaggccacgccgtgatggtagagaagaaagcggcgggcgaaggagatgttgcccccacagtcttgcaagcaagcaactatggcgttcttgtgcacgcgccacgagcggtagccttggcgctgttgttgctcttgggctaa

SEQ ID NO: 845 - DNA, 2421 bp, Adenovirus C6
  MISC_FEATURE (1)..(2421): C6.orf00030 100K protein
atggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttctgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtag

SEQ ID NO: 846 - DNA, 1590 bp, Adenovirus C6
  MISC_FEATURE (1)..(1590): C6.orf00031 DBP DNA binding protein
atggccagtcgggaagaggagcagcgcgaaaccacccccgagcgcggacgcggtgcggcgcgacgtccaccaaccatggaggacgtctcgtccccgtcgccgtcgccgccgcctccccgcgcgcccccaaaaaagcggctgaggcggcgtctcgagtccgaggacgaagaagactcgtcacaagatgcgctggtgccgcgcacacccagcccgcggccatcgacctcgacggcggatttggccattgcgtccaaaaagaaaaagaagcgcccctctcccaagcccgagcgcccgccatccccagaggtgatcgtggacagcgaggaagaaagagaagatgtggcgctacaaatggtgggtttcagcaacccaccggtgctaatcaagcacggcaagggaggtaagcgcacggtgcggcggctgaatgaagacgacccagtggcgcggggtatgcggatgcaagaggaaaaggaagagtccagtgaagcggaaagtgaaagcacggtgataaacccgctgagcctgccgatcgtgtctgcgtgggagaagggcatggaggctgcgcgcgcgttgatggacaagtaccacgtggataacgatctaaaggcaaacttcaagctactgcctgaccaagtggaagctctggcggccgtatgcaagacctggctaaacgaggagcaccgcgggttgcagctgaccttcaccagcaacaagacctttgtgacgatgatggggcgattcctgcaggcgtacctgcagtcgtttgcagaggtaacctacaagcaccacgagcccacgggctgcgcgttgtggctgcaccgctgcgctgagatcgaaggcgagcttaagtgtctacacgggagcattatgataaataaggagcacgtgattgaaatggatgtgacgagcgaaaacgggcagcgcgcgctgaaggagcagtctagcaaggccaagatcgtgaagaaccggtggggccgaaatgtggtgcagatctccaacaccgacgcaaggtgctgcgtgcatgacgcggcctgtccggccaatcagttttccggcaagtcttgcggcatgttcttctctgaaggcgcaaaggctcaggtggcttttaagcagatcaaggctttcatgcaggcgctgtatcctaacgcccagactgggcacggtcaccttctgatgccactacggtgcgagtgcaactcaaagcctgggcatgcaccctttttgggaaggcagctaccaaagttgactccgttcgccctgagcaacgcggaggacctggacgcggatctgatctccgacaagagcgtgctggccagcgtgcaccacccggcgctgatagtgttccagtgctgtaaccctgtgtatcgcaactcgcgcgcgcagggcggaggccccaactgcgacttcaagatatcggcgcccgacctgctaaacgcgttggtgatggtgcgcagcctgtggagtgaaaacttcaccgagctgccgcggatggttgtgcctgagtttaagtggagcactaaacaccagtatcgcaacgtgtccctgccagtggcgcatagcgatgcgcggcagaacccctttgatttttaa

SEQ ID NO: 847 - DNA, 630 bp, Adenovirus C6
  MISC_FEATURE (1)..(630): C6.orf00033 L3 protease
atgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaaacatgtaaaaataatgtactag

SEQ ID NO: 848 - DNA, 2892 bp, Adenovirus C6; identical to SEQ ID NO: 205
  MISC_FEATURE (1)..(2892): C6.orf00035 L3 hexon

SEQ ID NO: 849 - DNA, 753 bp, Adenovirus C6
  MISC_FEATURE (1)..(753): C6.orf00036 pVI hexon-associated protein 27 kDa
atggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgcgtccctgcgccgcgccgccagcggtccgcgatcgttgcggcccgtagccagtggcaactggcaaagcacactgaacagcatcgtgggtttgggggtgcaatccctgaagcgccgacgatgcttctga

SEQ ID NO: 850 - DNA, 243 bp, Adenovirus C6; identical to SEQ ID NO: 736
  MISC_FEATURE (1)..(243): C6.orf00038 L2 X core protein

SEQ ID NO: 851 - DNA, 1143 bp, Adenovirus C6
  MISC_FEATURE (1)..(1143): C6.orf00039 pV
atgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaa

SEQ ID NO: 852 - DNA, 597 bp, Adenovirus C6
  MISC_FEATURE (1)..(597): C6.orf00040 L2 VII core protein
atgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgctatgactcagggtcgcaggggcaacgtgtactgggtgcgcgactcggttagcggcctgcgcgtgcccgtgcgcacccgccccccgcgcaactag

SEQ ID NO: 853 - DNA, 1710 bp, Adenovirus C6
  MISC_FEATURE (1)..(1710): C6.orf00043 pIII
atgtatgaggaaggtcctcctccctcctacgagagcgtggtgagcgcggcgccagtggcggcggcgctgggttcacccttcgatgctcccctggacccgccgttcgtgcctccgcggtacctgcggcctaccggggggagaaacagcatccgttactctgagttggcacccctattcgacaccacccgtgtgtaccttgtggacaacaagtcaacggatgtggcatccctgaactaccagaacgaccacagcaactttctaaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgctcgcttactaaggacaaacaggtggagctgaaatacgagtgggtggagttcacgctgcccgagggcaactactccgagaccatgaccatagaccttatgaacaacgcgatcgtggagcactacttgaaagtgggcaggcagaacggggttctggaaagcgacatcggggtaaagtttgacacccgcaacttcagactggggtttgacccagtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgacctggagggtggtaacattcccgcactgttggatgtggacgcctaccaggcaagcttgaaagatgacaccgaacagggcgggggtggcgcaggcggcggcaacaacagtggcagcggcgcggaagagaactccaacgcggcagctgcggcaatgcagccggtggaggacatgaacgatcatgccattcgcggcgacacctttgccacacgggcggaggagaagcgcgctgaggccgaggcagcggccgaagctgccgcccccgctgcggaggctgcacaacccgaggtcgagaagcctcagaagaaaccggtgattaaacccctgacagaggacagcaagaaacgcagttacaacctaataagcaatgacagcaccttcacccagtaccgcagctggtaccttgcatacaactacggcgaccctcaggccgggatccgctcatggaccctgctttgcactcctgacgtaacctgcggctcggagcaggtatactggtcgttgcccgacatgatgcaagaccccgtgaccttccgctccacgcgccagatcagcaactttccggtggtgggcgccgagctgttgcccgtgcactccaagagcttctacaacgaccaggccgtctactcccagctcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttga

SEQ ID NO: 854 - DNA, 1758 bp, Adenovirus C6
  MISC_FEATURE (1)..(1758): C6.orf00044 pIIIa
atgatgcaagacgcaacggacccggcggtgcgggcggcgctgcagagccagccgtccggccttaactccacggacgactggcgccaggtcatggaccgcatcatgtcgctgactgcgcgcaaccctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgatgaggccggcctggtctacgacgcgctgcttcagcgcgtggctcgttacaacagcagcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtatcagtccgggccagactattttttccagaccagtagacaaggcctgcagaccgtaaacctgagccaggctttcaagaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgttagccgcgcgctggggcaggaggacacgggcagcctggaggcaaccctgaactacctgctgaccaaccggcggcaaaaaatcccctcgttgcacagtttaaacagcgaggaggagcgcattttgcgctatgtgcagcagagcgtgagccttaacctgatgcgcgacggggtaacgcccagcgtggcgctggacatgaccgcgcgcaacatggaaccgggcatgtatgcctcaaaccggccgtttatcaatcgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacaacgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaagaacctgcctccggcgtttcccaacaacgggatagagagcctagtggacaagatgagtagatggaagacgtatgcgcaggagcacagggatgtgcccggcccgcgcccgcccacccgtcgtcaaaggcacgaccgtcagcggggtctggtgtgggaggacgatgactcggcagacgacagcagcgtcttggatttgggagggagtggcaacccgtttgcacaccttcgccccaggctggggagaatgttttaa

SEQ ID NO: 855 - DNA, 1248 bp, Adenovirus C6
  MISC_FEATURE (1)..(1248): C6.orf00045 52K protein
atgcatccggtgctgcggcagatgcgcccccctcctcagcagcggcaagagcaagagcagcggcagacatgcagggcaccctccccttctcctaccgcgtcaggaggggcaacatccgcggctgacgcggcggcagatggtgattacgaacccccgcggcgccggacccggcactacttggacttggaggagggcgagggcctggcgcggctaggagcgccctctcctgagcgacacccaagggtgcagctgaagcgtgacacgcgcgaggcgtacgtgccgcggcagaacctgtttcgcgaccgcgagggagaggagcccgaggagatgcgggatcgaaagttccatgcagggcgcgagttgcggcatggcctgaaccgcgagcggttgctgcgcgaggaggactttgagcccgacgcgcggaccgggattagtcccgcgcgcgcacacgtggcggccgccgacctggtaaccgcgtacgagcagacggtgaaccaggagattaactttcaaaaaagctttaacaaccacgtgcgcacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacattctgcagagcatagtggtgcaggagcgcagcttgagcctggctgacaaggtggccgccattaactattccatgctcagtctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaa

SEQ ID NO: 856 - DNA, 117 bp, Artificial Sequence
  C6.orf00046 hypothetical protein
atgctttcgctttccagcctaaccgcttacgccgcgcgcggccagtggccaaaaaagctagcgcagcatccgccgcgcctggaaggaagccaaaaggagcgctcccccgttgtctga

SEQ ID NO: 857 - DNA, 1962 bp, Adenovirus C6
  MISC_FEATURE (1)..(1962): C6.orf00052 pTP
atggagcactttttgccgctgcgcaacatctggaaccgcgtccgtgactttccgcgcgcctccaccaccgccgccggcatcacctggatgtccaggtacatctacggatatcatcgccttatgttggaagacctcgcccccggagccccggccaccctacgctggcccctctaccgccagccgccgccgcactttttggtgggataccagtacctggtgcggacttgcaacgactacgtctttgactcaagggcttactcgcgtctcaggtacaccgagctctcgcagccgggtcaccagaccgttaactggtccgttatggccaactgcacttacaccatcaacacgggcgcataccaccgctttgtggacatggacgacttccagtctaccctcacgcaggtgcagcaggccatattagccgagcgcgttgtcgccgacctggccctgcttcagccgatgaggggcttcggggtcacacgcatgggaggaagagggcgccacctacggccaaactccgccgccgccgcagcgatagatgcaagagatgcaggacaagaggaaggagaagaagaagtgccggtagaaaggctcatgcaagactactacaaagacctgcgccgatgtcaaaacgaagcctggggcatggccgaccgcctgcgcattcagcaggccggacccaaggacatggtgcttctgtcgaccatccgccgtctcaagaccgcctactttaattacatcatcagcagcacctccgccagaaacaaccccgaccgccgcccgctgccgcccgccacggtgctcagcctaccttgcgactgtgactggttagacgcctttctcgagaggttttccgatccggtcgatgcggactcgctcaggtccctcggtggcggagtacctacacaacaattgttgagatgcatcgttagcgccgtatccctgccgcacggcagccccccgccaacccataaccgggacatgacgggcggcgtcttccaactgcgcccccgcgagaacggccgcgccgtcaccgagaccatgcgccgtcgccgcggggagatgatcgagcgctttgtcgaccgcctcccggtgcgccgtcgtcgccgccgtgtcccccctcccccaccgccgccagaagaagaagaaggggaggcccttatggaagaggagattgaagaagaagaagaggcccctgtagcctttgagcgcgaggtgcgcgacactgtcgccgagctcatccgtcttctggaggaggagttaaccgtgtcggcgcgcaactcccagtttttcaacttcgccgtggacttctacgaggccatggagcgccttgaggccttgggggatatcaacgaatccacgttgcggcgctgggttatgtacttcttcgtggcagaacacaccgccaccaccctcaactacctctttcagcgcctgcgaaactacgccgtcttcgcccggcacgtggagctcaatctcgcgcaggtggtcatgcgcgcccgcgatgccgaagggggcgtggtctacagccgcgtctggaacgagggaggcctcaacgccttctcgcagctcatggcccgcatctccaacgacctcgccgccaccgtggagcgagccggacgcggagatctccaggaggaagagatcgagcagttcatggccgagatcgcctatcaagacaactcaggagacgtgcaggagattttgcgccaggccgccgtcaacgacaccgaaattgattctgtcgaactctctttcaggttcaagctcaccgggcccgtcgtcttcacgcagaggcgccagattcaggagatcaaccgccgcgtcgtcgcgttcgccagcaacctccgcgcgcagcaccagctcctgcccgcgcgcggcgccgacgtgcccctgccccctctcccggcgggtcccgagccccccctacctccgggggcccgcccgcgtcaccgcttttag

SEQ ID NO: 858 - DNA, 3309 bp, Adenovirus C6
  MISC_FEATURE (1)..(3309): C6.orf00054 E2B DNA polymerase
ttgcaagccatcgacgccgccaccaaccagcccctggaaatcaggtatcacctggacctagcccgcgccctgacccggctatgcgaggtaaacctgcaggagctcccgcctgacctgacgccgcgggagctccagaccatggacagctcccatctgcgcgatgttgtcatcaagctccgaccgccgcgcgcggacatctggactttgggctcgcgcggcgtggtggtccgatccaccgtaactcccctcgagcagccagacggtcaaggacaagcagccgaagtagaagaccaccagccaaacccgccaggcgaggggctcaaattcccactctgcttccttgtgcgcggtcgtcaggtcaacctcgtgcaggatgtacagcccgtgcaccgctgccagtactgcgcacgtttttacaaaagccagcacgagtgttcggcccgtcgcagggacttctactttcaccacatcaacagccactcctccaactggtggcgggagatccagttcttcccgatcggctcgcatcctcgcaccgagcgtctctttgtcacctacgatgtagagacctatacttggatgggggcctttgggaagcagctcgtgcccttcatgctggtcatgaagttcggcggagatgagcctctagtgaccgccgcgcgagacctagccgcggaccttggatgggaccgctgggaacaagacccgcttaccttctactgcatcaccccagaaaaaatggccataggtcgccagtttaggacctttcgcgaccacctgcaaatgctaatggcccgtgacctgtggagctcattcgtcgcttccaaccctcatcttgcagactgggccctttcagagcacgggctcagctcccctgaagagctcacctacgaggaacttaaaaaattgccttccatcaagggcatcccgcgcttcttggaactttacattgtgggccacaacatcaacggctttgacgagatcgtgctcgccgcccaggtaattaacaaccgttccgaggtgccgggacccttccgcatcacacgcaactttatgcctcgcgcgggaaagatactcttcaacgatgtcaccttcgccctgccaaacccgcgttccaaaaagcgcacggactttttgctctgggagcagggcggatgcgacgacactgacttcaaataccagtacctcaaagtcatggttagggacacctttgcgctcacccacacctcgctccggaaggccgcgcaggcatacgcgctacccgtagaaaagggatgctgcgcctaccaggccgtcaaccagttctacatgctaggctcttaccgttcggaggccgacgggtttccgatccaagagtactggaaagaccgcgaagagtttgtcctcaaccgcgagctgtggaaaaaaaagggacaggataagtatgacatcatcaaggaaaccctggactactgcgccctagacgtgcaggtcaccgccgagctggtcaacaagctgcgcgactcctacgcctccttcgtgcgtgacgcggtaggtctcacagacgccagcttcaacgtcttccagcgtccaaccatatcatccaactcacatgccatcttcaggcagatagtcttccgagcagagcagcccgcccgtagcaacctcggtcccgacctcctcgctccctcgcacgaactatacgattacgtgcgcgccagcatccgcggtggaagatgctaccctacatatcttggaatactcagagagcccctctacgtttacgacatttgcggcatgtacgcctccgcgctcacccaccccatgccatggggtcccccactcaacccatacgagcgcgcgcttgccgcccgcgcatggcagcaggcgctagacttgcaaggatgcaagatagactacttcgacgcgcgcctgctgcccggggtctttaccgtggacgcagaccccccggacgagacgcagctagacccactaccgccattctgctcgcgcaagggcggccgcctctgctggaccaacgagcgcctacgcggagaggtagccaccagcgttgaccttgtcaccctgcacaaccgcggttggcgcgtgcacctagtgcccgacgagcgcaccaccgtctttcccgaatggcggtgcgttgcgcgcgaatacgtgcagctaaacatcgcggccaaggagcgcgccgatcgcgacaaaaaccaaaccctgcgctccatcgccaagttgctgtccaacgccctctacgggtcgtttgccaccaagcttgacaacaaaaagattgtcttttctgaccagatggacgcggccaccctcaaaggcatcaccgcgggccaggtgaatatcaaatcctcctcgtttttggaaactgacaatcttagcgcagaagtcatgcccgcttttgagagggagtactcaccccaacagctggccctcgcagacagcgatgcggaagagagtgaggacgaacgcgcccccacccccttttatagccccccttcaggaacacccggtcacgtggcctacacctataaaccaatcaccttccttgatgccgaagagggcgacatgtgtcttcacaccctggagcgagtggaccccctagtggacaacgaccgctacccctcccacttagcctccttcgtgctggcctggacgcgagccttcgtctcagagtggtccgagtttctatacgaggaggaccgcggaacaccgctcgaggacaggcctctcaagtctgtatacggggacacggacagccttttcgtcaccgagcgtggacaccggctcatggaaaccagaggtaagaaacgcatcaaaaagcatgggggaaacctggtttttgaccccgaacggccagagctcacctggctcgtggaatgcgagaccgtctgcggggcctgcggcgcggatgcctactccccggaatcggtatttctcgcgcccaagctctacgcccttaaaagtctgcactgcccctcgtgcggcgcctcctccaagggcaagctgcgcgccaagggccacgccgcggaggggctggactatgacaccatggtcaaatgctacctggccgacgcgcagggcgaagaccggcagcgcttcagcaccagcaggaccagcctcaagcgcaccctggccagcgcgcaacccggagcgcaccccttcaccgtgacccagactacgctgacgaggaccctgcgcccgtggaaagacatgaccctggcccgtctggacgagcaccgactactgccgtacagcgaaagccgccccaacccgcgaaacgaggagatatgctggatcgagatgccgtag

SEQ ID NO: 859 - DNA, 1128 bp, Adenovirus C6
  MISC_FEATURE (1)..(1128): C6.orf00055 IVa2 pIVa2
atgctggatcgagatgccgtagagcacgtgaccgagctgtgggaccgcctggaactgcttggtcaaacgctcaaaagcatgcctacggcggacggcctcaaaccgttgaaaaactttgcttccttgcaagaactgctatcgctgggcggcgagcgccttctggcggatttggtcagggaaaacatgcaagtcagggacatgcttaacgaagtggcccccctgctcagggatgacggcagctgcagctctcttaactaccagttgcagccggtaataggtgtgatttacgggcccaccggctgcggtaagtcgcagctgcttaggaacctgctttcttcccagctgatctcccctaccccggaaacggttttcttcatcgccccgcaggtagacatgatccccccatctgaactcaaagcgtgggaaatgcaaatctgtgagggtaactacgcccctgggccggatggaaccattataccgcagtctggcaccctccgcccgcgctttgtaaaaatggcctatgacgatctcatcctggaacacaactatgacgttagtgatcccagaaatatcttcgcccaggccgccgcccgtgggcccattgccatcattatggacgaatgcatggaaaatcttggaggtcacaagggcgtctccaagttcttccacgcatttccttctaagctacatgacaaatttcccaagtgcaccggatacactgtgctggtggttctgcacaacatgaatccccggagggatatggctgggaacatagccaacctaaaaatacagtccaagatgcatctcatatccccacgtatgcacccatcccagcttaaccgctttgtaaacacttacaccaagggcctgcccctggcaatcagcttgctactgaaagacatttttaggcaccacgcccagcgctcctgctacgactggatcatctacaacaccaccccgcagcatgaagctctgcagtggtgctacctccaccccagagacgggcttatgcccatgtatctgaacatccagagtcacctttaccacgtcctggaaaaaatacacaggaccctcaacgaccgagaccgctggtcccgggcctaccgcgcgcgcaaaacccctaaataa

SEQ ID NO: 860 - DNA, 423 bp, Adenovirus C6; identical to SEQ ID NO: 784
  MISC_FEATURE (1)..(423): C6.orf00056 pIX

SEQ ID NO: 861 - DNA, 1302 bp, Adenovirus C6
  MISC_FEATURE (1)..(1302): C6.orf00058 E1B large T antigen
atggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattga

SEQ ID NO: 862 - DNA, 528 bp, Adenovirus C6; identical to SEQ ID NO: 786
  MISC_FEATURE (1)..(528): C6.orf00059 E1B 19K protein

SEQ ID NO: 863 - DNA, 312 bp, Adenovirus C6; identical to SEQ ID NO: 787
  MISC_FEATURE (1)..(312): C6.orf00060 E1A 26 kDa protein

SEQ ID NO: 864 - DNA, 519 bp, Adenovirus C6
  MISC_FEATURE (1)..(519): C6.orf00061 E1A
atggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtga

SEQ ID NO: 865 - DNA, 378 bp, Adenovirus D8
  MISC_FEATURE (1)..(378): D8.orf00002 E4 ORF1 protein
atggctgaatgtctctatgcttttatagatagccctggagggatggctcccgtccaggaaggggctagcaataaatatacctttttttgtcctgaatctttttatatttttccgcatggggtggtattggtttacctaaaagtcagtgtactcgttcctactggttatcagggcacatttatggctttaaatgactaccatgccaggggcatactaacccagtccgatgtgatttttgccgggagaagacaggagcttgctgtactgctttttaatcacacggaccaatttttgtatgtccgcaagggccacccagtgggcaccctgctgctaaaaaaagtaatttttccttcagtaaaaatagccaccttggtttag

SEQ ID NO: 866 - DNA, 393 bp, Adenovirus D8
  MISC_FEATURE (1)..(393): D8.orf00003 E4 ORF2 protein
atgcttcagcgacgcggtgtaagctaccacattgtggtccctggggtcctagtgacgtatttagaggatttttctattactaacatgattaaagaaaaactacctcgctttattactcacattttggaaggcattaccggagatacaaaaagagcttattccagcatgcagtttttaggtgctagctttggagcattaaagtactcccttacgcttgccagtcccacgcttagccctggctctgaattgtcagctgtagtggcccaggacttaagtgactttttgcagctgacacttagacgtcagctaagggctgagggcagaaccttattaaatgttgttgttttaaacacgctgcaggtggtggagcagcaggatttgtttctattatga

SEQ ID NO: 867 - DNA, 354 bp, Adenovirus D8
  MISC_FEATURE (1)..(354): D8.orf00004 E4 ORF3 protein
atgaaggtctgcctgattatgaaagtggagggggcgctatgggagcttttccacatgtgcggagtggacttacaccaacaatttgtagaaataatccaaggctggaaaaatgagaattacctggggatggtgcaggaatgtaacatgatgattgatgaaatcgatggagggccggcttttaatgtgattcttatgctggatgtacgcgtagagccactgctcgaagccacagtcgagcaccttgaaaatagagtgggttttgacctggctgtatgtttccaccaacacagcggcggtgaacgctgtcacctgcgtgacttgcactttatcgtccttcgagaccgtttggaataa

SEQ ID NO: 868 - DNA, 879 bp, Adenovirus D8
  MISC_FEATURE (1)..(879): D8.orf00009 E4 control protein 34 kDa
atgagcaccaaggaacaatcaaccttgctccgccattatccatatcgcagggcccgtttaccacgatatgataaggagaccagggcctctttgactgaacaacaccctgtattgcccgattgtgatcatgcagattatcataatgtaagttctgtccgtggattaccatgtgctgctggttttaccctgctccaagagtttccagtcccctgggatatgatcctgacccgaaaggaaataaaaattttaaaaagatgtatgtcagtgtgcctgtgtcccgctaccctggatctggtaagagcccagatggtaagcgggtacgagcgctggatcctgcattgccactgtttatccccgggctccctgcagtgccgggcgggaggcaccctgctggccgtgtggtttaggagagtcatttacgggtgcatgttcaaccagcgcttcccctggtaccggcagattgtaaatagaaacatgtccaaagagattatgtatatgggcagtgtgtttataaggggcaggcacctgatatactgccgcatttggtacgatggtcacgtgggttccatcatttccaacataagctttggctggagcaccctaaattatgggctgctgaataacatggtcattatgtgctgcacttactgtgaaaacatgagcgagattaggatgcggtgctgtgcccgacgcaccagaagactaatgctaaaggctgtggggattatagtgaaagagacttgcgatcccgatcccatctgtagcagccgcaccgagccccggcggcagagactgttaagggcgctgatggagaggcacagacccattttgttttccgagtatgagtctgtgcgttcttctcattccaccagactgtga

SEQ ID NO: 869 - DNA, 246 bp, Adenovirus D8
  MISC_FEATURE (1)..(246): D8.orf00010 E4 ORF6/7 protein
gtgaccttggactgcgaggcccacttggatgatttttcaaaggacggcttcatctcaatcaccgacccccgtttggctcgccaggaaactgtgtggattataaaccccaagtccagttcccgcactaatgagaactttcccctatttaaggccacccgtgctgagagaattgtttacactgtaaaatgggctggtggtgggagaatgtgtacccgcgctggtgtaaaaatcaataaagatacatga

SEQ ID NO: 870 - DNA, 1089 bp, Adenovirus D8; identical to SEQ ID NO: 146
  MISC_FEATURE (1)..(1089): D8.orf00011 L5 fiber

SEQ ID NO: 871 - DNA, 150 bp, Adenovirus D8
  MISC_FEATURE (1)..(150): D8.orf00012 U protein
atgaaaattgtggaccaggaatttgacatccctttcaaggtgtggagaaagtttgccgcccgccggggactggagtaccagagctgggaggaggggactgaggtgctgctaaacaactacaccaaagacatactttcagattttaagtaa

SEQ ID NO: 872 - DNA, 318 bp, Adenovirus D8
  MISC_FEATURE (1)..(318): D8.orf00013 E3 CR1-alpha
gtgagtttaataaaagctgaaataagactctactctggaatccagtgtcgtcataatcgcaccgagaccattaactttaccacccaggaacaggtgaactttacctgcaaactccacaagaagtacctcatatggtttttcaacaacactactcttgcagtagttaacacctgtgacaacgacggtgttcttcttcccaacaatctcaccagtggactagccttctctgttaaaagggcaaagctaattcttcattgccctataactgatttaagcccaaaaaccaatcaaacccccttttcccatctacccaaataa

SEQ ID NO: 873 - DNA, 321 bp, Adenovirus D8
  MISC_FEATURE (1)..(321): D8.orf00014 E3 12.5 kDa immune modulating protein
atgtcctatggtgactcggctgagcttgctcggttaaggcatctggaccactgccgccgcctgcactgctttgcccgggagagctgcgggcttatctactttgagcttcccaaggagcaccccaacggccctgcacacggagtgcggattaccgtagagggcaccaccgagtctcacctggttaggttcttcacccagcaacccttcctggtcgagcgggaccgggctgcaaccacctacaccgtgtactgcatttgtccaaccccgaagttgcatgaaaatttttgctgtactctttgtggtgagtttaataaaagctga

SEQ ID NO: 874 - DNA, 684 bp, Adenovirus D8
  MISC_FEATURE (1)..(684): D8.orf00015 L4 VIII capsid protein
atgagcaaggagattcccacgccttacatgtggagctatcagccccagatgggcctagccgcgggcgcctcccaggactactccacccgcatgaactggctcagtgccgggccctcaatgatctcacaggtcaacgggatccgtaaccatcgaaaccagatattgttggagcaggcggcagtcacctccacgcccagggcaaagcttaacccgcgtaattggccctccaccctggtgtaccaggaaattcccgggccaactaccgtactacttccgcgtgacgcactggccgaagtccgcatgactaactcaggtgtccagctggccggcggcgcttcccggtgcccgctccgcccacaatcgggtataaaaaccctggtgatccgaggcaaaggcacacagcttaacgacgagttggtaagctctgcaatcggtctgcgacctgatggagtgtttcaactagccggagccgggaaatcgtcctttactcccaaccaggcctacctgaccttgcagagcagctcttcggagcctcgctccggaggcattggaaccctccagtttgtgcaggagtttgtgccctcggtctactttaaccccttctcgggatcgccaggcctttacccggacgagtttataccgaactttgacgcagtgagagaagcggtggacggctacgactaa

SEQ ID NO: 875 - DNA, 186 bp, Adenovirus D8
  MISC_FEATURE (1)..(186): D8.orf00016 L4 encapsidation protein
gtgaagggtgacggtaagcaccagcggcagggctaccgatcatggagggcccacaaagccgcgatcattgcctgcttgcaagactgcggggggaacattgcttttgcccgccgctacctgcttttccaccgcggggtaaacatcccccgcaacgtgttgcattactaccgtcaccttcacagctaa

SEQ ID NO: 876 - DNA, 2145 bp, Adenovirus D8
  MISC_FEATURE (1)..(2145): D8.orf00017 L4 hexon-assembly protein
atggaggagcagccgcgtaagcaggagcaggaggaggagaacttaaccacccacgagcaacccaaaattgagcaggacctgggcttggaagagccggctcgtctagaacccccacacgatgaacaggagaagaccaacgctgggctggagcatggctacctaggaggacaggaggatgtgctgctaaaacacttgcagcgccagtcctttatcctccgggacgctctggccgaccgaagcaaaacccccctcagcgtccaggagctgtgtcgggcctacgagctcaacctcttctcgccgcgcgtgccccccaaacgccagcccaacggcacctgcgagcccaacccgcgtcttaacttctaccccgtctttgcggtccccgaggcccttgccacttatcacatattttttaaaaaccaaaaaatccccgtttcctgccgcgccaaccgcacccgcgccgacgcactcctcgctctggggcccggcgcgcgcatacctgatatcgcttccctggaagaggtgcccaagatctttgaagggcttggtcgggacgagacgcgcgcggcgaacgctctaaaagaaacagcagaggaaaagggttacactagcgccctggtagagttggaaggcgataacgccaggctggccgtgcttaagcgcagcgtcgagcttacccatttcgcctaccctgccgttaacctcccgcccaaggtcatgcgtcgcatcatggatcagcttatcacgccccacattgaggcccttgatgaaagccaaaagcagcgccctgaggacgcccggcccgtggtcagcgacgaaatgcttgcgcgctggctcggaaaccgcgacccccagtccctggagcagcggcgtaagctcatgctggccgtggtcctggtcaccctcgagttggaatgcatgcgccgcttttttagcgaccccgaaaccctgcgcaaggttgaagagaccctgcactacactttcaggcacggctttgtcaggcaggcctgcaagatctctaacgtggagctaaccaacctggtctcctgcctgggtattttacacgagaaccgcctggggcagaccgtgcttcactcgaccctgaagggcgaggcgcggcgggactacatccgcgactgtgtctttctttttctttgccatacctggcagtcggccatgggcgtgtggcagcagtgtctccaggacgagaacctgaaggagctggacaagcttcttgctaaaaaccttaaaaagttatggacgggctttgacgagcgcaccgtcgcctcggacctggccgagattgtttttcctgaacgcctgaggcagacgcttaaaggcgggctgcccgactttatgagccagagcatgttgcaaaactaccgcactttcattctcgagcgatcgggaatcctgcccgccacctgcaacgccttcccctccgactttgtcccgctgagctaccgccagtgtcccccgccgctgtggagccactgctacctcttgcagctggccaactacatcgcccaccactcggacgtgatcgaggacgtaagcggcgaggggctgcttgagtgccactgccgctgcaacctgtgctccccgcaccgctccctggtctgcaacccccagctcctaagcgagacccaggtcatcggtacctttgagctgcaaggtccggaaaactccaccactccgctgaaacttacgccggggttgtggacttccgcgtacctgcgcaaatttgtaccccaggactaccacgcccacgagataaagttctttgaggaccaattgtgcccacagcacgcggatcttacggcctgcgtcatcacccagggcgcaatcctcgcccaattgcacgccatccaaaaatcccgccaagagtttcttctaaaaaagggtaaaggggtttacctggacccccagacaggcgaagtgcttaacccgggtcttccccagcatgccgaggaagaagcaggagccactagtggaggagatggaagaagaatgggacagccaggcagaggaggacgaatgggaggaggaggaggaagaattggaagaggtgcaacaggagcaggcaacagagcagcccgtcgccgcaccatccgcgccggcagcccctccggtcaagcctcctcgtag

SEQ ID NO: 877 - DNA, 1473 bp, Adenovirus D8
  MISC_FEATURE (1)..(1473): D8.orf00019 E2A ssDNA-binding protein
atggccggcggcagtcaggacgtgcgccggtttatggaccgagaggccactccgccccggggccacgggtcggcgcgctatccgccggagcaggaaaggagcccctcgccgccgctacctcctctgcccaccaagcgccgaaagtatcagcgggtgggctccgggtcttccgaggaggacgtggttccagtggacagccctccaaaaaagaagcagcccagaaagaccaaacatgtgaccaaggtaaaccccgacgaagagatgccccaggaagatgccgtgatcgtgggagtgggattcagccagccgccggttctgttgaaggaaggcaaggacggaaaacgcattgtcgagcccgcgacccctggtattttgaacgtgcgcaaccccctgagtctgcctttggtttcgtcctgggagaagggcatggataccataaacgtgctcatggaacgctaccgcgtcgacagcggcctgcgcaatgcttacaagcttatgccggagcagaccgagatattccaaaaaatgtgccagacctggatgaacgaggaggcccgcgggatgcaactgacctttaccacccagaagagctttagcaccgtgatgggtcgcctgttgcaaggttacatctttagccacagcgggatcgcgcacaaaaactgggagtgcaccggcagtgccctgtgggaccacggctgtgccgaggtggaaggccagcttaagtgtctgcacgggacggtaatgatccacaaggaccatgtggtggagatggatgtgaccagcgagaacggtcagcgcgcgttgaaggagcaacccagcaaggccaaagtgacccagaaccgctgggggagaagcgtggtgcaactgaccagccatgacgcgcgctgctgcgtgcaagatgccgggtgcggaaataaccagtttagcgggaaaagctgcggcctgttttttagcgagggagctaaggcccagcaagcttttaagcagattatggcctttgttaaggccctatacccgaatatgcagcgcggtgcgggaatgatgctaatgcccgtgcactgcgagtgtaaccacaagccccacagcgtgcccttcctgggccgccagctgtgtaagatgaccccgttcggcctgagcaacgccgaggacctggacaaggatcaaattagcgataagagcgtgctggccagcgtaaagtaccccagtctgatggtgttccagtgctgcaaccctgtgtaccgcaactcgcgcgcgcaaagcaccggtcccaactgcgattttaagatctccgccccggacatgctgggcgccctgcaaatgagccggcgcatgtggagcgagaccttccccgagattgctgttcctaaactggtgatccccgagtttaagtggcagcccaagtaccagtaccgcaacgtggcccttcccagcgcggcgcacaacgacgagcgcgagaacccctttgacttttaa

SEQ ID NO: 878 - DNA, 624 bp, Adenovirus D8
  MISC_FEATURE (1)..(624): D8.orf00020 L3 protease
atgagcggctccagcgaacaagagcttgcggccatcgtgcgcgacctgggctgcgggccctactttttgggcacccacgacaagcgcttcccgggcttccttgccggcaacaagctggcatgcgccatcgtcaacacggccggccgcgaaaccgggggcgtgcactggcttgcctttggctggaacccgcgctcgcgcacctgctacatgtttgacccctttgggttctcggaccgccggcttaagcagatttacagcttcgagtacgaggccatgttgcgtcgcagtgccctggccttatcgcccgaccgctgtcttagcctcgagcagtccacccagaccgtgcaggggcccgactccgccgcctgcggactcttttgttgcatgttcttgcatgcctttgtgcactggcccgatcgacccatggacgggaaccccaccatgaacttgctgacgggggtgcccaatggcatgctacaatcgccacaggtactgcccaccctccggcgcaaccaggagaagctctaccgcttccttgcgcaccactccccctactttcgctcccaccgcgccgccatcgaacacgccaccgcttttgataaaatgaaacaactgcgtgtataa

SEQ ID NO: 879 - DNA, 2859 bp, Adenovirus D8; identical to SEQ ID NO: 206
  MISC_FEATURE (1)..(2859): D8.orf00022 L3 hexon

SEQ ID NO: 880 - DNA, 702 bp, Adenovirus D8
  MISC_FEATURE (1)..(702): D8.orf00023 L3 VI capsid protein
atggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcaacgctccggacctatgggaacaaggcctggaatagtagcacagggcagatgttgagggaaaagcttgcagaccaaaacttccagcaaaaggtggtggacggcctggcctcgggcattaacggggtagtggacattgcaaaccaggccgtgcagcgcgagataaacagccgcctgaacccgcggccgcccacggtagtggagatggaagatgcaactcttccccccaggggcgagaagcggccgcggcctgacgcggaggagacaaccctgcaggtagacgagccgccctcgtacgaggaggccctcaaggccggcatgcccaccacacgcatcattgcgccaatggccacgggtgtcatgaaacccgccacccttgacctgccttcaccacccgtgcccgctccaccaaaggcagctccggttgagcaggcccccccggtggcaaccgccgtgcgccgcgttcccgcccgccgccaggcccagaactggcagagcacgctacacagtatcgtgggcctaggagtgaaaagtctgaagcgccgccgatgctattaa

SEQ ID NO: 881 - DNA, 984 bp, Adenovirus D8
  MISC_FEATURE (1)..(984): D8.orf00025 L2 V core protein
atgtcaaagcgcaaaatcaaggaggagatgctccaggtcgtcgccccggagatttacggaccaccccaggcggaccagaaaccccgcaaaatcaagcgggttaaaaaaaaggatgaggtggacaaggaggcagtagagtttgtgcgcgagtttgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtatggcgacgacgacatcctggaccaggcggcggagcgggcgggcgagttcgcctacgggaagcggtcgcgcgaagaggagctgatctcgctgccgctggacgagagcaaccccacgccgagcctgaagcccgtgaccctgcagcagatgctgccccaagcagtgctgctgccgagccgcggggttaagcgcgagggcgagaacatgtacccgaccatgcagatcatggtgcccaagcgtcggcgcgtggaggacgtgctggacaccgtgaaaatggatgtggagccccaggtcaaggtgcgccccatcaagcaggtggcgccgggcctgggcgtgcagaccgtggacattcaaatccccaccgacatggatgtcgacaaaaaaccctcgaccagcatcgaggtgcagaccgacccctggctcctagcctccaccgccgccacggccaccgagcctcccaggaggcgaagatggggccctgccaaccggttgatgcccaactacgtgttgcatccttccatcattccgacgccgggctaccgcggcacccggtattacgccagccgcaggcgccccgcaggcaagcgccgtcgccgcaccaccacccgccgccgtctggcccccgcccgcgtgcgccgcgtaactacgcgccggggccgctcgcttgttctgcccaccgtgcgctaccaccccagcatcctttaa

SEQ ID NO: 882 - DNA, 591 bp, Adenovirus D8
  MISC_FEATURE (1)..(591): D8.orf00027 L2 VII core protein
atgtccattcttatctcgcccagcaataacaccggctggggtcttactaggcccagcaccatgtacggaggagccaagaagcgctccgatcagcaccccgttcgcgtccgcggccactttcgcgctccctggggcgcttacaagcgcgggcggacctctgcccccgccgccgtgcgcaccaccgtcgacgatgtcattgactcggtagtcgctgacgcgcgcaactacacccccgccccctccaccgtggacgcggtcattgacagcgtggtggctgacgcgcgcgactatgccagacgcaagagccggcggcgacgcattgccaggcgccaccggagcacgcccgccatgcgcgccgcccgggctctgctgcgccgtgccagacgcactggccgccgggccatgttgcaagccgcgcgtcgcgccgccgccgcacccacccccacaggcaggactcgcagacgagcggccgttgccgccgccgcggccatctctagcatgaccagacccaggcgcggaaacgtgtactgggtgcgcgactccatcacgggcgtgcgcgtgcccgtgcgcacccgtcctcctcgtccctga

SEQ ID NO: 883 - DNA, 1470 bp, Adenovirus D8; identical to SEQ ID NO: 176
  MISC_FEATURE (1)..(1470): D8.orf00029 L2 penton

SEQ ID NO: 884 - DNA, 225 bp, Adenovirus D8
  MISC_FEATURE (1)..(225): D8.orf00030 L2 penton
atgctgtttctgccctccgtaggagccatataccgcggaggcacaaacggaacctccagggtcgcctgcgccatcacgctttcgtacgagggaggaggagaggacaccaccgcgcgcctcatttctaacaaggaagagaacgcacgctatggccttggtgagttttattttgcatttaaaacatccgtcgccccagtctgggctgcagatgcgcgaacgggttaa

SEQ ID NO: 885 - DNA, 1698 bp, Adenovirus D8
  MISC_FEATURE (1)..(1698): D8.orf00031 L1 IIIa capsid protein
atgtcccagcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactgtcggccattttggaggcggtggtcccctctcggaccaaccccacgcacgagaaggtgctggcgatcgtgaacgcgctggcggagaacaaggccattcgtcccgacgaggccgggctggtgtacaacgccctgctggagcgcgtgggccgctacaacagcacaaacgtgcagtccaacctggaccggctggtgacggacgtgcgcgaggccgtggcgcagcgcgagcggttcaagaacgagggcctgggctcgctggtggcgctaaacgccttcctggcgacgcagccggcaaacgtgccgcgcgggcaggacgattacaccaattttatcagcgcactgcggctgatggtgaccgaggtgccccagagcgaggtgtaccagtcgggcccggactactttttccagactagcagacagggcctgcagacggtaaacctgagccaggctttcaagaacctgcgcgggctgtggggcgtgcaggcgcccgtgggcgaccggtcgacggtgagcagcttgctgacgcccaactcgcggctgctgctgctgctgatcgcacccttcaccgacagcggcagcgtaaaccgcaactcgtacctgggccacctgctgacgctgtaccgcgaggccataggccaggcgcaggtggacgagcaaaccttccaggagatcacgagcgtaagccgcgcactggggcagaacgacaccgacagtctaagggccacccttaacttcttgctgaccaatagacagcagaagatcccggcgcaatatgcgctgtcggccgaggaagaaaggattctgagatatgtgcagcagagcgtagggctgttcctgatgcaggagggggccacccccagcgccgcgctggacatgaccgcgcgcaacatggaacctagcatgtacgccgccaaccggccgtttattaataagctgatggactacctgcaccgcgcggcgtccatgaactcggactactttaccaatgccatcttgaacccgcattggctcccgccgccagggttctacacgggcgagtacgacatgcccgaccccaacgatgggtttttgtgggacgacgtggacagcgcggtgttctccccaattttgcaaaagcgccaggaggcggtgcgcacgcccgcgagcgagggcgcggtgggtcggagcccctttcctagcttgggcagcttgcatagcctgcctgactcagtaaacagcggcagggtgagtcggccgcatttgctgggcgaggacgagtacctgaacgactcgctgctgcggccgccgcgggccaagaacgccatggccaataacgggatagaaagtctggtggacaaactgaaccgctggaagacctacgctcaggaccatagggaacctgcgcccgcgccgcggcgacagcgccacgaccggcagcggggcctggtgtgggacgacgaggactcggccgacgatagcagcgtgttggacttgggcgggagcggtagggttaacccgttcgcgcatctgcagcccagactggggcgacggatgttttaa

SEQ ID NO: 886 - DNA, 1119 bp, Adenovirus D8
  MISC_FEATURE (1)..(1119): D8.orf00032 L1 52 kDa protein
atgcatcccgtcctgcgccaaatgcgtcccacccccccggcgaccaccgcaaccgcggccgtagcaggcgccggcgctgtacaacagcagacagagatggacttggaagagggcgaagggctggcgagactgggggcgccgtccccggagcaacacccccgcgtgcagctgcaaaaggacgtgcgcccggcgtacgtgcctgcgcagaacctgttcagggaccgcagtggggaggagcccgaggagatgcgcgactgccggtttcgggcgggcagggagctgcgcgagggcctggaccgccagcgcgtgctgcgcgacgatgattttgagccaaacgagcagacggggatcagccccgcgcgcgcgcacgtggcggcggccaacctggtgacggcctacgagcagacggtaaaacaggagcgcaacttccaaaagagttttaacaaccacgtgcgcaccctgatcgcgcgcgaggaggtggccctgggcctgatgcacctatgggacctggcggaggccatcgtacagaacccgaacagcaagcctctgacggcgcagctgttcctggtggtgcagcacagcagggacaacgaggcgtttagggaggcgctgctaaacattgccgagcccgagggtcgctggctgctggagctaattaacattttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtaaagatagacagcttttacatgcgcatggcgctcaaggtgctaacgctgagcgacgacctgggtgtgtaccgcaacgaccgcattcacaaggccgtgagcacaagccggcggcgcgagctaagcgaccgcgagctgatgatgagcctgcgccgggcgctggtagggggcgccgccagcggcgaagagtcctactttgacatgggggcggacctgcattggcagccgagccggcgcgccttggaggccgcctacggtccagaggacttggatgaggatgaggaagaggaggaggatgcacccgctgcggggtactga

SEQ ID NO: 887 - DNA, 1851 bp, Adenovirus D8
  MISC_FEATURE (1)..(1851): D8.orf00034 pTP DNA terminal protein
atggattatttcctaccgctgcgcaacatctggaaccgcgtccgcgagttcccgcgcgcctccaccaccgccgccggcatcacctggatgtcccgctacctctacggctaccaccgcctcatgctcgaggacctggccccgggcgcgccggccacccagcgctggccgctgtaccgccagccgccgccgcacttcctagtcggatatcagtaccttgtgcgcacctgcaacgactacgtctttgactcgcgcgccttctcgcggcttaggtactccgaggtcgtgcagcccggtttgcaaaccgttaactggtcgcttatggccaactgcacctacaccatcaacaccggggcctaccaccgctttgttgacatggacgacttccaagacaccctcacccgcgtgcaacaggccatcctcgccgagcgtgtcgtcgccgacctggcgctcgtgcagccgcttaggggcgtcggggtcacccgcatggaagactccgcctccgccgcaaatgatgacattgagaggctcatgcatgactactacaagaacctcagccggtgtcagggtcaggcctggggcatggccgagcggctccgcatacagcaagcgggacccaaggacctggtccttcttgccaccatccgccgcctgaaaaacgcctacttcaattacatcattagcaatcgcaattgtaacagtgtccacagggctgctacgtgtttaagcttaccttgtgactgcgattggctagacgctttccttcaaaaattttccgatccggtcgatcttgacgtgcttacgtcccctacaccgcaattaataagatgcattgttagcgccctttcgctacccaacggggacccgccctattaccgggagatgaccggcggcgtcttcacgctgcgtcctcgcgaacagggtcgcgccgtcactgaaaccatgcgtcgccgccgcggggagatgatcgagcgcttcgtcgaccgtctcccggtgcgtcgccgtcgtcgtcgggccccgccaccaccaccgcccccagaagaaatacaagaagaggtcgttatggaacaggaagaagaggaggcccccggggattttgagcgcgaggtgcgcgccaccatcgccgagctcatccggcttctggaagacgagcttacggtatcggcccgcaacgcccagtttttcaacttcgccgtggacttctacgaggctatggaaaggctggaggccattggcaacatcagcgaaatgcccctgcgccgctggattatgtacttttttgttaccgagcacattgccaccacccttaactacctttttcagcgcctgcgcaactacgccgtttttacgcggcacgtggagcttaaccttgcgcaggtggtcatgcgcgcgcgcgacgttgacggggacgtggtgtacagccgcgtctggaacgagagcggcctgggcgccttttcgcagcttatggaccgcatctcgaatgaccttgccgctaccgtcgagcgtgcgggtcgcggcgatctccaggaggaggagatcgagcagttcatgtccgagatcgcctaccaggacaactcgggcgacgtgcaagagatcctgcggcaggccgccgtcaatgacgccgagattgattctgttgaactgtctttcaggttcaaagtcacgggacccgtggtcttcacgcagaggcggcagatccaggatgtcaaccgccgcgtcgtcgcgcacgccagcgctctcagggcacagcaccgggacctgcccgagcgccacgccgacgtgcctctgccgcccctgcccatggggccggaaccgccgctgccgccgggagcgcgtccgcgacaccgcttttaa

SEQ ID NO: 888 - DNA, 3300 bp, Adenovirus D8
  MISC_FEATURE (1)..(3300): D8.orf00037 E2B DNA polymerase
gtggccccgcgcagctacgggctcatgcaatgcgtggacacggccaccaactcacccgtagaaatcaagtaccatttgcatctcaagcacgccctcacccgcctctacaaggtcaaccttagaaccctgcccccggacctggatctccgcgacaccatggacagctcccaactgcgcgcccttgtcttcgctctccgcccccgccgcgccgagatctggacctggctcccgcgcgggcttgtcagcctctccgtcctcgaggagccccagggtaagtcctacgcaggcgaacatgaaaaccaccagccagggccgccactcctgaagtttttccttaagggacgcgctgtgtatctcgtggataaggtacagcccgtgcagcgctgcgagtattgcggacgcttttacaagcatcagcacgagtgctcggttcgccggagggatttctactttcatcacatcaacagccactcgtccaactggtggcaggaaatccagttcttcccaatcggctctcatcctcgcacggagcggctctttgtcacctacgatgtagaaacctacacctggatggggtccttcggcaagcagctcgtccccttcatgctggtcataaaattctccggggaccccaagctggtcgcccttgctcgcgatcttgccgtgcgtttacgctgggatcgctgggagcgggacccccttaccttttactgcatcacccccgaaaagatggccgtgggccagcagttccgcctctttcgcgacgagcttcagacccttatggcccgcgagctctgggcttctttcatgcaagccaacccacatctccaggagtgggcactggagcagcacggcctgcaatgccctgaggaccttacctacgaggagcttaaaaagctgccgcacatcaaaggccgcccgcgatttatggaactatacatcgtcgggcacaacatcaacggctttgacgagattgtcctagccgcccaggttatcaacaaccgagcctgcgtcccgggccctttccgtatcacccgcaatttcatgccacgagcaggcaagattctcttcaatgacgtcactttcgctctgcctaaccccctctcaaagaagcgcacagattttgagctatgggaacacggcggctgcgacgactcggactttaagtaccagtttttgaaagtcatggtcagggacacctttgccctgacgcacacctcgctccgcaaggccgctcaagcttacgccctccccgtggagaagggctgctgtccctacaaggccgttaaccatttctacatgctgggctcttaccgtgcggacgatcaaggattcccgctccgggagtactggaaggatgacgaggagtacgcccttaaccgcgagctgtgggagaagaaaggacagacgggttatgacattatccgcgaaacgctggactactgcgccatggacgtccttgtcactgccgagctggttgccaagctgcaagactcctacgcgcactttatccgcgactcggtccgcctgccccacgcccactttaacatcttccaacggcccactatttcctccaactcgcatgccatctttcgccagatcgtctttcgcgccgagcagccccagcgtaccaatcttggccccgccttcttggcaccctcgcatgagttgtatgactacgtgcgcgccagcatccgcggggggcgctgttatcccacctacatcggcatcctctcggagcccatctatgtgtatgacatctgcggcatgtacgcctccgcgcttacgcatcccatgccctggggtccgcccctgaacccctgcgagcgagccctggccgcccgcaagtggcaaatggccttggatgatgcatccttaaaaattgattattttgacaaggaactctgtccgggcatcttcaccatcgatgcggacccccctgacgagcatttgcttgatgtgttaccacctttttgctcgcgcaagggcgggcgcctctgctggaccaacgaacccctgcgcggcgaggtggccaccagcgtggacctggtcaccctgcataaccgaggctggcgcgtcaggattgtgcccgacgagcgcaccactgtttttcccgaatggaagtgcgttgcgcgcgaatatgtccagctcaacattgcggccaaggagcgcgccgaccgtgacaaaaatcagaccatgagatccatcgccaagcttctctccaacgccctctatggctcctttgccaccaagcttgacaataaaaaaatagtcttttctgaccagatggatgaaagtctcctgaaaagcattgcgacagggcaggccaacatcaaatcctcctcgtttctagaaactgacaacctgagtgccgaggtcatgccagctctcgagaggcaatacctaccccaacagctgacgctcgtggacagcgacgcggaagagagtgaggacgagcacagacccgcccccttttatacccctccgtcgggaacccccggtcacgtggcctacacctacaagccaatcaccttcttggatgcggaggagggggacatgtgtctgcacacggtggaaacggtggaccccctggtggacaatgaccgctacccctcgcacgtggcctcctttgtcttggcgtggacgcgcgcctttgtctcagagtggtccgagtttctttacgaggaggaccgcgggacgcccctgcaggacaggccaatcaagtccgtctacggggacaccgacagcctgtttgtcaccgagcgcggacacagactcatggagacgcgaggtaagaagcgcatcaaaaagaacgggggaaaactggtttttgaccccaagcagcccgagctcacctggcttgttgagtgcgagaccgtctgcgtccactgcggagcggatgcctttgccccagagtccgtttttctcgcgcctaaactctacgccctgcaatccctcctctgtcccgcctgtgggcgctcttccaagggcaagctccgcgccaagggccatgccgccgagacccttaactaccagcttatggtcaactgctatcttgccgacgcgcagggcgaagaccgtgcccgtttcagcaccagcaggatgagtctcaagcgcacccttgcaagcgcccagcccggggcccaccccttcaccgtgacggagaccaccctcacgcggaccctgagaccctggaaggacatgacgctggttgcgctggacgcccatcgtcttgtgccctacagtcgcagtcgtcccaacccccgaaacgaggaagtctgctggatccagatgccgtag

SEQ ID NO: 889 - DNA, 1047 bp, Adenovirus D8
  MISC_FEATURE (1)..(1047): D8.orf00039 IVa2 maturation protein
atgcccatggccgacgggcttaagcccctaaaaaactttgcttccctgcaagaactgctctcgctgggcggggaccgcctccttagcgagcttgttcgggaaaacctccaagtcagagacatgcttaaccaggtagcccccctcctccgggacgacggcagctgcatctccttgaactaccacctgcaacccgtcatcggggtcatctacggcccaaccgggtgcggcaagtcccagctgttaagaaacctgctctcctcgcagctcatcacccccgccccggaaaccatttttttcatcgccccgcaggtggacatgatccccccctccgagatgaaagcctgggagatgcagatctgcgaggggaacttcgccccggggcccgagggaaccatcgtcccacaatctggcaccctccgccccaaattcattaaaatgtcttatgatgatctcacccaagagcataattacgatgtctctgaccccagaaacgtctttgccaaagccgcagcccacgggcccattgccatcatcatggatgagtgcatggaaaacctgggcgggcacaagggcgtctccaaattcttccacgctttcccttccaagttgcatgacaagttccccaagtgcacgggctacaccgtcctggtggtcctgcacaacatgaacccccggcgggatctgggcggtaacatcgccaaccttaagatccaggccaaactacacatcatctccccccgcatgcatccctcccagctcaaccgctttgccaacacctacaccaaggggctccccgtggccatcagtctcctccttaaggacatcatccagcaccacgcccagcgcccctgctatgactggatcatctacaacacaaccccagaacacgaggccatgcagtggtgctacctccacccccgggacgggcttatgcccatgtacctcaacatccaatcccacctctaccgggtcctggaaaaaatccaccgcactcttaatgatcgggagaggtggaccagggcctaccgcgcgcgaaaaaataaataa

SEQ ID NO: 890 - DNA, 408 bp, Adenovirus D8
  MISC_FEATURE (1)..(408): D8.orf00041 IX hexon associated protein
atgaacgggaccggcggggcctttgaaggggggctttttagcccttatttgacaacccgcctgccgggatgggccggagttcgtcagaatgtgatgggatcaacggtggacgggcgcccagtgcttccagcaaattcctctaccatgacctacgcgaccgtggggacgagctcgtcgcttgacagcaccgccgcagccgcggcagccgcagccgccatgacagcgacgagactggcctcgagctacatgcccagcagcggtagcagcccctccatccccagttccatcatcgccgaggagaaactgctggccctgctggctgagctggaagccctgagccgccagctgaccgccctgacccaggaggtgtccgagctccgcgaacagcagcagcagcaaaataaatga

SEQ ID NO: 891 - DNA, 1197 bp, Adenovirus D8
  MISC_FEATURE (1)..(1197): D8.orf00042 E1B large T antigen
atggccaggggagtgaagagggagaggagcgatgggggcaatactgggctgatgacccagctaactgccagcctgatgaatcgcaagcgcccagagcgtattacctggcacgagctacagcaggagtgcagggatgagataggcctgatgcaggataaatatggcctggagcaaataaaaacccattggttgaacccagacgaggattgggaggaggccattaagaaatatgccaagatagccctgcgcccagattgcaagtacagggtgactaagaccgtgaatattaaacatgcctgctacatctcggggaacggggcagaggtggacatcgatactctggacaagtcagccttcaggtgttgcatgatgggaatgagagcaggagtaatgaatatgaattccatgatctttataaacataaagttcaatggagagaagtttaatggggtactgtttatggccaacagccacatgaccctgcatggttgcagtttttttggctttaacaatatgtgtgcagaggtctggggtgctgctaagattaggggatgtaagttttacggctgctggatgggcgtggttggaagacccaagagcgagatgtctgtaaagcagtgtgtgtttgaaaaatgctacctgggagtctgtaccgagggcaatgctagagtaagacactgctcttccctagagacgggctgcttttgcctggtgaagggcacagcctcgattaagcataatgtggtaaagggctgcacggatgagcgcatgtacaacatgctgacctgcgactcgggggtctgccatatcctgaagaacatccatgtgacctcccaccccagaaaaaagtggccagtgtttgagaataacctgctgattaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcggtggcagacacaccaggatgcagccagtggccctggatgtgaccgaggagctgcgaccagaccacctggtgatggcctgtaccgggaccgagttcagctccagtggggaggacacagattag

SEQ ID NO: 892 - DNA, 432 bp, Adenovirus D8
  MISC_FEATURE (1)..(432): D8.orf00044 E1B small T antigen
gtgtacacagttaagaaggattatagcgaggaatttgaaaatctttttgccgactgctctggcctgctagattctttaaattttggccaccagtcccttttccaggaaagggtactccacagccttgatttttccagcccagggcgcactacagccggggttgcttttgtggtttttttggttgacaaatggagccaggacacccaactaagcaggggctacattctggactttgcagccatgcacctgtggagggcctggatgaggcagcggggacagagaatcttgaactactggcttctacagccagcagcttcgggtcttcttcatctacacagacaaacatccatgttggaggaagaaatgagggaggccatggacaagaacccgaggagcggcctggaccctccgtcggaagaggagctggattaa

SEQ ID NO: 893 - DNA, 207 bp, Adenovirus D8
  MISC_FEATURE (1)..(207): D8.orf00045 E1A 21 kDa protein
gtgtcagaggatgagtcatcacctttagaagaagaccacccgtctccccctgatcttacaaatgacacgcccctgcaagtgcgcagacccaccccggttagaccgagtggcgagaggcgagcggctgtttacaaaattgaggatttgttgcaggacgtgggtgggaatgaacctttgaacctgagcttgaaacgccccaggaactag

SEQ ID NO: 894 - DNA, 132 bp, Adenovirus D8
  MISC_FEATURE (1)..(132): D8.orf00046 E1A 28 kDa protein
atgcgtgtgtggttgtggaaaatcattttgtgttggacaatcctgaggtgccagggcaaggctgtaaatcctgtcaatatcaccgggaacagaccggagacccaaatgcttcctgcgctctgtgttacatga

SEQ ID NO: 895 - DNA, 120 bp, Artificial Sequence; identical to SEQ ID NO: 228
  D8.orf00048 hypothetical protein

SEQ ID NO: 896 - DNA, 378 bp, Adenovirus D9
  MISC_FEATURE (1)..(378): D9.orf00004 E4 14.0 K E4 ORF1 14.0 kDa protein
atggctgaatctctgtatgctttcatagatagtcctggagggatcgctcccgtccaggaagggactagcaatagatataccttcttttgccctgaatctttccacattcctccgcatggggtggtattgcttcacctaaaagtgagtgtgctggttcctactggatatcagggcagatttatggccttgaatgactaccatgccagggacatactaacccagtccgatgtgatttttgccggaagaagacaggaacttactgtgctgctttttaatcacacggaccgatttttgtatgtccgcaagggccacccagtgggtaccctgttgctggagagagtgatttttccttcagtaaaaatagccaccttagtttag

SEQ ID NO: 897 - DNA, 393 bp, Adenovirus D9
  MISC_FEATURE (1)..(393): D9.orf00005 E4 14.5 K E4 ORF2 14.5 kDa protein
atgcttcagcgacgcggtgtaagctaccacattgtggtccctggggtcctagtgacttatttagaggacttttctattacgcaaatgattaaagaaaaactaccacgctttatcactcacattttggaaggcatcaccggagacacaaagagagcttattccagcatgcagtttttgggtgctagctttggagcattaaagttttcccttacgcttgccagtcccacgcttagccctggctctgaattgtcagctgtagtggcccaggacttaagtgactttttgcagctgacattgaggcgcgagctcagggcggagggcagaaccttattgaatcttgttgttttgaacacgctgcaggtggtggagcagcaggatctgtttctattatga

SEQ ID NO: 898 - DNA, 336 bp, Adenovirus D9
  MISC_FEATURE (1)..(336): D9.orf00007 E4 13.6 K E4 ORF 3 13.6 kDa protein
atgaaagtggagggggcactgtgggagcttttccacatgtgcggagtggacttacaccaacaatttgtagagataattcaaggctggaaaaatgagaattacctggggatggtgcaggaatgtaacctgatgattgatgaaatcgatggagggccagcctttaatgtgattcttatgctggatgtacgcgtagagccactgctcgaagccacggtcgagcaccttgaaaatagagtgggttttgacctggctgtctgtttccaccagcacagcggaggggaacgctgtcacctgcgtgacttgcactttatcgtccttcgagaccgtttggaataa

SEQ ID NO: 899 - DNA, 879 bp, Adenovirus D9
  MISC_FEATURE (1)..(879): D9.orf00011 E4 34.1 K E4 ORF6 34.1 kDa protein
atgcaaaccgagattcaatccagctcgctccgccatcatccatatcgcagggcccgtttaccacgatctgatgaggaaaccagggcttcactgactgaacaacatcccctgttgcccgattgtgatcatgcagattatcataatgtaagttctgtccgtggattaccatgtgctgctggctttaccctgctccaagagtttccagtcccctgggatatgatcctgaccccagaggaaataaaaattttaaaaagatgtatgtcagtgtgcctgtgccctgctaccctggacttggtgagagctcagatggtgagcgggtacgagcgctggatcctgcattgccactgttcatccccgggctccctgcagtgtcgggcgggaggcaccctgctggccgtgtggttcaggagagtcatttacgggtgcatgttcaaccagcgcttcccctggtaccgtcagattgtgaacagaaacatgcccaaagagatcatgtatatgggcagtgtgtttatgaggggcaggcacctgatatactgccgcatctggtacgatggtcacgtgggttccatcatccccaacatgagctttggctggagcgccctgaattatgggctgctgaataacatggtgattatgtgctgcacttactgtgagaacatggcagagatcaggatgcggtgctgtgcccgacgcaccaggagactgatgctgaaggctgtggggattatagtcagagagacttgcgatcccgatccaatctgcagcagccgcaccgagccccggcggcagagactgctgagggcgctgatggagaggcacagacccatcctgttttccgagtatgaatctgtgcgttcttctcattccaccagactgtga

SEQ ID NO: 900 - DNA, 246 bp, Adenovirus D9
  MISC_FEATURE (1)..(246): D9.orf00012 E4 ORF6/7 protein
gtgaccttggactgtgaggctcgcttggatgacttttcagaggacggcttcatctcaatcaccgacccccgtttggctcgccaggaaactgtgtggattatagaccccaagtccagttcccgcactaatgagaacatttccctatttaaggccacccgtgctgagagaacagtgtacactgtgaaatgggctggtggtgggagactgactacccgtgctggtgtaaaaatcaataaagatacatga

SEQ ID NO: 901 - DNA, 1089 bp, Adenovirus D9; identical to SEQ ID NO: 147
  MISC_FEATURE (1)..(1089): D9.orf00016 L5 pIV 39.3 kDa fiber protein

SEQ ID NO: 902 - DNA, 150 bp, Adenovirus D9
  MISC_FEATURE (1)..(150): D9.orf00017 U protein
atgaaaattgtggaccaggaatttgacatccctttcaaggtgtggaggaagttcgccgcccgccggggactggaataccagagctgggaggagggtaacgaggtgctgctgaacaactacaccagagacatactttcagatttcaagtaa

SEQ ID NO: 903 - DNA, 393 bp, Adenovirus D9
  MISC_FEATURE (1)..(393): D9.orf00019 E3 14.8 K E3 14.8 kDa protein
atgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgccttgtcaaacaggcaaagatcacctacgagctcgtgtccggcggcaagcagcatcgcctcacctatgagctgccccagcagaagcagaagttcacctgcatggtgggcgtcaaccccatagtcatcacccagcagtcgggcgagaccaacggctgcatccactgctcctgcgaaagccccgagtgcatatactccctcctcaagaccctttgcggactccgcgacctcctccccatgaactga

SEQ ID NO: 904 - DNA, 390 bp, Adenovirus D9
  MISC_FEATURE (1)..(390): D9.orf00021 E3 14.5 K E3 14.5 kDa protein
atgcagactctgctcatgctgctatccctcctatcccctgccctcgccacttctgctgactctaaatgcaaattcgcggagatatggaatttcttagattgctatcaggagaaaattgatatgccctcctattacttggtgattgtgggaatagtcatggtctgctcctgcactttctttgccatcatgatctacccctgttttgatctcggctggaactctgttgaggcattcacatacacactagaaagcagttcactagcctccacgccaccgcccacaccgcctccccgcagaaatcagttcccactgattcagtacttagaagagccccctccccggcccccttccactgttagctactttcacataaccggcggcgatgactga

SEQ ID NO: 905 - DNA, 276 bp, Adenovirus D9
  MISC_FEATURE (1)..(276): D9.orf00022 E3 10.4 K E3 ORF 4 10.4 kDa protein
atgattcctaggttcttcctatttaacatcctcttttgtctcttcaacatctgtgctgccttcgcggccgtctcgcacgcctcgcccgactgtctagggcctttccccacctacctcctctttgccctgctcacctgcacctgcgtctgcagcattgtctgcgtggtcatcaccttcctgcagctcatcgactggtgctgcgcgcgctataattatctccaccacagtcccgaatacagggacgagaacgtagccagaatcttaaggctcatctga

SEQ ID NO: 906 - DNA, 789 bp, Adenovirus D9
  MISC_FEATURE (1)..(789): D9.orf00023 E3 33.1 K E3 ORF3 33.1 kDa protein
atgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatctgtgaatggaatgttactgcatataaatgcttcaataatggaagcattactattactgccactgccaacattacttctggcacatacaaagctgaaagctataaaaatgaaatcaaaaaactaacctataaaaacaacaaaaccacatttgaagattctggaaattatgaacatcaaaaattatctttttatatgttgacaataattgaactgcctacaactaaggctcccaccacaaccagtacaactattaagaccactactcacactacagtgcaaaatactactttattgattgggtttttactgagagagaatgaaagtactactgaacagacagaggctacctcaagtgccttcagcagcactgcaaatttaacttcgcttgcttggactaatgaaaccggagtatcattgatgcatggccagccttactcaggtttggatattcaaattacttttctggttgtctgtgggatctttattcttgtggttcttctgtactttgtctgctgcaaagccagagagaaatctaggaggcccatctacaggccagtgattggggaacctcagccactccaagtggatggaggcttaaggaatcttctcttctcttttacagtatggtga

SEQ ID NO: 907 - DNA, 1230 bp, Adenovirus D9
  MISC_FEATURE (1)..(1230): D9.orf00024 E3 45.8 K E3 45.8 kDa protein
atgaatactttgaccagtgtcgtgctgctctctcttcttgtagcttttagtcaggcaggaattattaacttaaatgtatcatggggaatgaatctaactttagtgggaccctcagacctgccagttacatggtatgatggaaagggaatgcagttttgtgatggaaatacaattaagaacccacaaatcaagcatagctgtaatcaacagaatctaactttacttaatgctgacaagtctcatgaaagaacttacctaggttacagacatgacagtaagggaaaagtagactataaggttacagtcataccacctcctccagccactcgcaagcctttgtcagagcctcattatgttactgtgactatgggcgataacataactttagtgggaccctcagacctgccagttacatggtatgatggagaaggaaataaattctgcgatggagaaaaagttgaacatgcagaatttaatcatacatgtaacatccagaacctgacactgctctttgtcaacttaacgcataatggagcatacattggttataacaaagacggttctgatagagaattatatgaggtgtcagtcaaaaccttgtttcagaacggggctggacaaagtaaggttgaacaaggtaataaagggaaacctaatactgctcaaagtggtggtaaaaaaaccaaaacagaacatagaaaccagagtccaaaaagaaaatcaacaaataaccttcagccaacacaattgtatgttaggccttttactaatgttagtttaactggacctccaaatggcaaggttacttggtatgatggcgaacttaatgatccatgtgaacaaaagtacaaactcagaactttttgcaatcagcaaaatctaactttaattaatgtaagcagcacttatgatggcatctattatggcactgatgaaaaagataaggcaaatcgttacagaataaaagtaaatactacaaatcacaaaactgttaaaattaagccacataccagagaacctcctgctgtacaagaaaaacagtttgaattacaagatgcagaaactgatgaaaacgaatcaaaaattccctcagctactgtggcaatcgtggtgggagtgattgcgggctttgtaactctgatcattgtcttcatatgctacatctgctgccgcaagcgtcccaggtcatacaatcatatggtagacccactactcagcttctcttactga

SEQ ID NO: 908 - DNA, 504 bp, Adenovirus D9
  MISC_FEATURE (1)..(504): D9.orf00026 E3 18.4 K E3 18.4 kDa protein
atgctgggtcagacattgtggggaggaactatgaaggggctcttgctgattatcctttccctggtggggggtgtgctgtcatgccacgaacagccacgatgtaacatcaccacaggcaatgagaggagtgtcatatgcacagtagtcatcaaatgcgagcatgaatgccctctcaacatcacattcaaaaaccgtaccatggggaatgcatgggtgggcgactgggaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggaaaacatggttgggttttctttggcttttgtgatcatggcctgctttatgtcaggtctgctggtaggagctctagtgtggttcctgaaacgcaagcccaggtatggaaatgaggagaaggaaaaattgctataa

SEQ ID NO: 909 - DNA, 564 bp, Adenovirus D9
  MISC_FEATURE (1)..(564): D9.orf00027 E3 21.8 K E3 21.8 kDa protein
gtgagtttaataaaagctaaactcttgcaatactctggaccttgtcgtcatcaactcaacgagaccgtctacctcaccaaccagactgaggtaaaactcacctgcagaccacacaagacctatatcatctggttcttcgagaacacctcatttgcagtctcaaacactcactgcaacgacggtgttgaacttccaaacaacctttccagtggactgagttacgatacacatagagctaagctcgtcctctacaatcctttcgtagagggaacctaccactgccagagcggaccttgcttccacagttttactttggtgaacgttaccggcagcagcacagccgctccagaacctaaccttccttctgatactatcaaacctcgtttcggaggtgagctaaggcttcccccttctgaggagggggttagcccatacgaagtggtcgggtatttgattttaggggtggtcctgggtgggtgcatagcggtgctagctcagctgccttgctgggtagaaatcaaaatctttatatgctgggtcagacattgtggggaggaactatga

SEQ ID NO: 910 - DNA, 321 bp, Adenovirus D9
  MISC_FEATURE (1)..(321): D9.orf00028 E3 12.2 K E3 12.2 kDa protein
atgtcccatggtgactctgctgagctcgctcggttgaggcatctggaccactgccgccgcctgcgctgcttcgcccgggagagctgcggactcatctactttgagtttcccgaggagcaccccaacggtcctgcacacggagtgcggatcaccgtagagggcaccaccgagtctcacctggtcaggttcttcacccagcaacccttcctggtcgagcgggaccggggcgccaccacctacaccgtctactgcatctgtccgaccccgaagttgcatgagaatttttgctgtactctttgtggtgagtttaataaaagctaa

SEQ ID NO: 911 - DNA, 684 bp, Adenovirus D9
  MISC_FEATURE (1)..(684): D9.orf00029 L4 pVIII L4 pVIII protein
atgagcaaggagattcccaccccttacatgtggagctatcagccccagatgggcctggccgcgggcgcctcccaagactactccacacgcatgaactggctcagtgccggcccctcgatgatatcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctcgggaggcatcggaaccctccagttcgtggaggagtttgtgccctcggtctacttcaaccccttctcgggatcgccaggcctctacccggacgagttcataccgaacttcgacgcagtgagagaagcggtggacggctacgactga

SEQ ID NO: 912 - DNA, 219 bp, Adenovirus D9
  MISC_FEATURE (1)..(219): D9.orf00030 L4 20 kDa protein
ttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaa

SEQ ID NO: 913 - DNA, 186 bp, Adenovirus D9
  MISC_FEATURE (1)..(186): D9.orf00032 L4 22 kDa protein
gtgaagggcgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaa

SEQ ID NO: 914 - DNA, 2199 bp, Adenovirus D9
  MISC_FEATURE (1)..(2199): D9.orf00034 L4 100k L4 100kDa protein
atggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacttgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgttttcgcggtccccgaggcccttgccacctatcacatttttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccactttgcctaccccgccgtcaacctcccgcccaaggtcatgcgtcacatcatggatcagctcatcatgccccacatcgaagccctcgatgaaagtcaggagcagcgccccgaggacgcccgacccgtggtcagcgacgagatgctcgcgcgctggctcgggacccgcgagccccaggctttggaacagcggcgcaagctcatgctggccgtggtcctggtcaccctcgagctcgaatgcatgcgccgcttcttcagcgaccccgagaccctgcgcaaagtcgaggagaccctgcactacactttcagacacggtttcgtcaggcaggcctgcaagatttccaacgtggagctgaccaacctggtctcctgcctggggatcctgcatgagaaccgcctgggacagaccgtactccactctaccctgaagggcgaggcgcggagggactatgtccgcgactgcgtctttctctttctctgccacacatggcaagcagccatgggcgtgtggcagcagtgtctcgaggacgagaacctgaaggagctggacaagcttcttgctagaaaccttaaaaagctttggacgggcttcgacgagcgcaccgtcgcctcggacctggccgagatcgtcttccccgagcgcctgaggcagacgctgaaaggcgggctgcccgacttcatgagccagagcatgttgcaaaactaccgcactttcattctcgagcgatcggggatgctgcccgccacctgcaacgctttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctccttagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcggccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacacgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgcagctccggccaagcctcctcgtag

SEQ ID NO: 915 - DNA, 1470 bp, Adenovirus D9
  MISC_FEATURE (1)..(1470): D9.orf00035 E2A DBP DNA binding protein
atggccggcggcagtcaggacgtgcgccggttcatggagcgagaggccactccgccccggggccacgggtcggcgcgctatccgccggagcaggagaggagcccctcgcctccacctcctctgcccaccaagcgccgaaagtatcagcgggtgggctccgggtcttccgaggaggacgtggtccccgtggacagccctccaaaaaagaagcaagccagaaagaccaagcatgtgaccaaggtagaccccgacgaagagatgccccaggaagatgccgtgatcgtgggagtgggattcagccagccgccggttctgttgaaggaaggcaaggacggaaaacgcatcgtcgagcccgcgacccccggtattctgaacgtgcgcaaccccctgagtctgcctctggtctcgtcctgggagaagggcatggataccatgaacgtgcttatggaacgctaccgcgtcgacagcggcctgcgcgatgcttacaagctcatgcccgagcagaccgagatcttccaaaagatgtgccagacctggatgaacgaggaggcccgcggtctgcaactgaccttcagcaccagtaaatcatttagcaccgtcatgggtcgcctgttgcaaggttacatcttcagccacagcgggatcgcacacaagaattgggagtgcaccggctgcgccctgtgggatcacggctgcaccgaggtggaaggccagctcaagtgtttgcacgggacggtgatgatccacaaggaccacgtggtggagatggatgtgaccagcgagaacggccagcgcgcgttgaaggagcagcctagcaaggccaaggtgacccagaaccgctggggacggagcgtggtgcaactgaccagccatgacgcgcgctgctgcgtgcatgatgccgggtgcgggaataaccagttcagcgggaagagctgcggcctgtttttcagcgagggggccaaggcccagcaagctttcaagcagatctcggcctttgtcaaggccctctacccgaatatgcagcgcggcgcggggatgatgctgatgcccgtgcactgcgagtgtaaccacaagcctcagagcgtgcccttcctgggccgccagctgtgcaagatgaccccgttcggcctgagcaacgccgaggacctggacaaggatcagatcagcgacaagagcgtgctggccagtgtgaagtaccccagtctgatggtgttccagtgctgcaaccccgtgtaccgcaactcgcgcgcgcagagcaccggccccaactgcgatttcaagatctccgccccggacatactgggcgccctgcagatgagccggcgcatgtggagcgagaccttccccgagaccccagtgcccaaactggtgatccccgagttcaagtggcagcccaagttccagtaccgcaacgtggccctccccagcgcggcgcacaacgacgagcgcgagaaccccttcgacttttaa

SEQ ID NO: 916 - DNA, 630 bp, Adenovirus D9
  MISC_FEATURE (1)..(630): D9.orf00037 L3 23.6 kDa protease
atgagcggctccagcgaacgagagctcgcggccatcgtgcgcgacctgggctgcgggccctactttttgggcacccacgacaagcgcttcccgggcttcctcgccggcgacaagctggcctgcgccattgtcaacacggccggccgcgagaccggaggcgtgcactggctcgccttcggctggaacccgcgctcgcgcacctgctacatgttcgacccatttgggttctcggaccgccggctcaagcagatttacagcttcgagtacgaggctatgttgcgccgaagcgccctggcttcctcgcccgaccgctgtctcagcctcgagcagtccacccagaccgtgcaggggcccgactccgccgcctgcggacttttctgttgcatgttcttgcatgccttcgtgcactggcccgaccgacccatggacgggaaccccaccatgaacttgctgacgggggtgcccaacggcatgctacaatcgccacaggtgctgcccaccctccggcgcaaccaggaggagctctaccgcttcctcgcgcgccactccccttactttcgctcccaccgcgccgccatcgaacacgccaccgcttttgacaaaatgaaacaactgcgtgtatctcaataa

SEQ ID NO: 917 - DNA, 2817 bp, Adenovirus D9; identical to SEQ ID NO: 207
  MISC_FEATURE (1)..(2817): D9.orf00042 L3 pII hexon protein

SEQ ID NO: 918 - DNA, 654 bp, Adenovirus D9
  MISC_FEATURE (1)..(654): D9.orf00043 L3 pVI L3 pVI protein
atgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgctaagggaaaagctcaaagaccagaactttcagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaaaggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcagctcccgcggtcgtgcaggcccccccggtggcgaccgccgtgcgccgcgtccccgcccgccgccaggcccagaactggcagagcacgttgcacagtatcgtaggcctgggagtgaaaagtctgaagcgccgccgatgctattga

SEQ ID NO: 919 - DNA, 117 bp, Adenovirus D9
  MISC_FEATURE (1)..(117): D9.orf00044 L2 pX core protein L2 pX
atgcgcaggcgcctgagtggcggctttctgcccgcgctcatccccataatcgccgcggccatcggcacgatcccgggcatagcttccgttgcgctgcaggcgtcgcagcgccgttga

SEQ ID NO: 920 - DNA, 1005 bp, Adenovirus D9
  MISC_FEATURE (1)..(1005): D9.orf00045 L2 pV minor core protein L2 pV
atgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcagtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccactgctaccgtctccacttctaccgccgccacggctaccgagcctcccaggaggcgaagatggggcgccgccagccggctgatgcccaactacgtggtgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaa

SEQ ID NO: 921 - DNA, 585 bp, Adenovirus D9
  MISC_FEATURE (1)..(585): D9.orf00046 L2 pVII major core protein L2 pVII
atgtctattctcatctcgcccagcaataacaccggctggggtcttactagacccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctga

SEQ ID NO: 922 - DNA, 1560 bp, Adenovirus D9; identical to SEQ ID NO: 177
  MISC_FEATURE (1)..(1560): D9.orf00047 L2-pIII penton

SEQ ID NO: 923 - DNA, 1596 bp, Adenovirus D9
  MISC_FEATURE (1)..(1596): D9.orf00051 L1 pIIIa L1 pIIIa 62.1 kDa protein
atgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggttccccagagcgaggtgtaccagtcgggcccggactactttttccagacgagccggcagggcttgcagacggtgaacctgagccaggctttcaagaacctgcgagggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaacttcttgctgaccaatagacagcagaagatcccggcgcaatatgcgctgtcggccgaggaggaaaggatcctgagatatgtgcagcagagcgtagggctgttcctgatgcaggagggggccacccccagcgccgcgctggacatgaccgcgcgcaacatggaacctagcatgtacgccgccaaccggccgttcatcaataagctgatggactacctgcaccgcgcggcggtcatgaacacggactactttacaaacgccatcctgaacccgcactggctcccgccgccggggttctacacgggcgagtacgacatgcccgaccccaacgacgggttcctgtgggacgacgtggacagcgtggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgttggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttga

SEQ ID NO: 924 - DNA, 1125 bp, Adenovirus D9
  MISC_FEATURE (1)..(1125): D9.orf00054 L1 52/55k L1 52/55k 42.2 kDa protein
atgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgctcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcactgctgaacatcgccgagcccgagggtcgctggctgctggagctgatcaacatcttgcagagcatcgtagtgcaggagcgcagcctgagcttggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctaagcgaccgcgagctgatgctgagcctgcgccgggcgctggtagggggcgctgccggcggcgaggagtcctacttcgacatgggggcggacctgcattggcagccgagccggcgcgccttggaggccgcctacggtccagaggacttggatgaggaagaggaagaggaggaggatgcacccgctgcggggtactga

SEQ ID NO: 925 - DNA, 1854 bp, Adenovirus D9
  MISC_FEATURE (1)..(1854): D9.orf00057 pTP 71.1 kDa preterminal protein
atggactatttcctgccgctgcgcaacatctggaaccgcgtccgcgagttcccgcgcgcctccaccaccgccgccggcatcacctggatgtcccgctacctctacggctaccaccgcctcatgctcgaggacctggccccgggcgcgccggccacccagcgctggccgctctaccgccagccgccgccgcacttcctagtcggctaccagtacctcgtgcgcacctgcaatgactacgtcttcgactcgcgcgccttctcgcggctcaggtactccgaggtcgtgcaacccggcctgcagaccgtcaactggtcgctcatggccaactgcacctacaccatcaacaccggggcctaccaccgctttgtcgacatggacgacttccaggacaccctcacccgcgtgcaacaggccatcctcgccgagcgcgtcgtcgccgacctggcgctcgtgcagccgctcaggggcgtcggggtcacccgcatggaagactccgcctccgccagtgatgacatcgagaggctcatgcatgactactacaagaacctgagccggtgtcagggccaggcctggggcatggccgagcggctccgcatccagcaagcgggacccaaggacctggtcctcctcgccaccatccgccgcctcaaaaacgcctacttcaattacatcatcagcaaccgcaattctaacagcgtccacagggctgctacgtgtttgagcttaccttgcgactgcgattggctagacgctttcctcgaaagattctccgatccggtcgatctcgacgcgctcacgtcccctacaccgcaattgataagatgcatcgtcagcgccctatcgctgcccaacggggacccgccccattaccgggagatgaccggcggcgtcttcacgctgcgtcctcgcgaacggggtcgcgccgtcaccgaaaccatgcgtcgccgccgcggggagatgatcgagcgcttcgtcgaccgtctcccggtgcgtcgccgtcgtcgtcgggccccgccaccaccaccgcccccagaggaagaaatagaagaagaggtcgtcatggaagaagaggaagaagaggaggcccccggggatttcgagcgcgaggtgcgcgccaccatcgccgagctcatccggctcctggaagacgagctcacggtctcggcccgcaatgcccagtttttcaacttcgccgtggatttctacgaggccatggaaaggctggaggccatcggcgacatcagcgagatgcccctgcgccgctggatcatgtacttcttcgtcaccgagcacatcgccaccaccctcaactacctcttccagcgcctgcgcaactacgccgtcttcacgcggcacgtggagctcaacctcgcgcaggtggtcatgcgcgcacgcgacgccgacggggacgtggtctacagccgcgtctggaacgagagcggcctgggcgccttctcgcagctcatgggccgcatctccaatgacctcgccgccaccgtggagcgcgcgggccgcggcgatctccaggaggaggagatcgaacagttcatgaccgagatcgcctaccaggacaactcgggcgacgtgcaagagatcctgcgtcaggccgccgtcaatgacgcagagattgattctgttgaactgtctttcaggttcaaagtcacggggcccgtggtcttcacgcagaggcggcagatccaggatgtcaaccgccgcgtcgtcgcgcacgccagcgctctcagggcgcagcaccgggacctgcccgagcgccacgccgacgtgcctctgccgcccctgcccgcggggccagaaccgccgctgccgccgggagcacgcccgcgacaccgcttctaa

SEQ ID NO: 926 - DNA, 3276 bp, Adenovirus D9
  MISC_FEATURE (1)..(3276): D9.orf00060 E2B DNA polymerase
atgcaatgcgtggacacgaccaccaactcacccgtggagatcaagtaccatctgcatctcaagcacgccctcacccgcctctacgaggtcaacctcagaaccctgcccccggacctggatctccgcgacaccatggacagctcccaactgcgcgccctcgtcttcgctctccgcccccgccgcgccgagatctggacctggctcccgcgcgggctcgtcagcctctccgtcctcgaggagccccagggtgagtcccacgcaggcgaacatgaaagccaccagccagggccgccactcctgaagttcctcctcaagggacgcgctgtgtatctcgtggatgaggtacagcccgtgcagcgctgcgagtactgcggacgcttttacaagcatcagcacgagtgctcggttcgccggcgggatttctactttcatcacatcaacagccactcgtccaactggtggcaggaaatccagttcttcccaatcggctctcatcctcgcacggagcggctctttgtcacctacgatgtagaaacctacacctggatggggtccttcggcaagcagctcgtccccttcatgctggtcatgaaattctcgggggaacccgagctggtcgccctcgctcgcgatctcgccgtgcgcttacgctgggatcgctgggagcgggaccccctcaccttctactgcgtcaccccagaaaagatggccgtgggccagcagttccgcctctttcgcgacgagctccagaccctcatggcccgcgagctctgggcttccttcatgcaagccaacccacatctccaggagtgggcgctagagcagcacggcctgcaatgccccgaggacctcacctacgaggagctcaaaaagctgccgcacatcaaaggccgcccgcgattcatggaactctacatcgtcgggcacaacatcaacggcttcgacgagatcgtccttgccgcccaggtgatcaacaaccgagcctccgtcccgggccctttccgcatcacccgcaatttcatgccgcgagcaggcaagattctcttcaatgacgtcactttcgctctgcctaaccccctctcgaagaagcgcaccgatttcgagctctgggagcacggcggctgcgacgactcggatttcaagtaccagttcttgaaagtcatggtcagggacaccttcgccctgacgcacacctcgctccgcaaggccgctcaagcttacgccctccccgtggagaagggctgctgtccctacaaggccgtgaaccatttctacatgctgggctcttaccgtgcggacgatcgaggattcccgctccgggagtactggaaggatgacgaggagtacgccctcaaccgcgagctgtgggagaagaaaggagaggcgggttatgacatcatccgcgaaacgctggactactgcgccatggacgtcctcgtcaccgccgagctcgtcgccaagctgcaagactcctacgcgcacttcatccgcgactcggtccgcttgccccacgcccactttaacatcttccaacggcccaccatctcctccaactcgcacgccatctttcgccagatcgtcttccgcgccgagcagccccagcgcaccaatctcggccccgccttcttggccccctcgcacgagttgtatgactacgtgcgcgccagcatccgcggggggcgctgttatcccacctacatcggcatcctctcggagcccatctatgtctacgacatctgcggcatgtacgcctccgccctcactcatcccatgccctggggtccgcccctcaacccctacgagcgagcgctggccgcccgcgagtggcagatggccttggatgatgcatcctcaaaaatcgattattttgacaaggaactctgtccgggcatcttcaccatcgatgcggacccccctgacgagcatctgcttgatgtgctgcccccgttctgctcgcgcaagggcggcagactctgctggaccaacgagcccctgcgcggcgaggtggccaccagcgtggacctggtcaccctgcataaccgcggctggcgcgtcaggatcgtgcccgacgagcgcaccaccgtcttccccgaatggaagtgcgtcgcgcgcgagtatgtccagctaaacatcgcggccaaggagcgcgccgaccgtgacaaaaatcagaccatgagatccatcgccaagcttctatccaacgccctctatggctccttcgccaccaagcttgacaataaaaaaatagtcttttctgaccagatggatgaaagtctcctaaaaagcatcgcggcagggcaagccaacatcaaatcctcctcgtttctagaaactgacaacctgagtgccgaggtcatgcccgctctcgagagggaatacctaccccaacagctggcgctcgtggacagcgacgcggaagagagtgaggacgagcacagacccgcccccttttatacccccccgtcggggacccccggtcacgtggcctacacctacaagccaatcaccttcttggatgcggaggagggggacatgtgtctgcacacggtggaaaaggtggaccccctagtggacaacgaccgctacccctcgcacgtggcctcctttgtcttggcgtggacgcgcgcctttgtctcagagtggtccgagtttctctacgaggaggaccgcgggacgcccctgcaggacaggccaatcaagtccgtctacggggacaccgacagcctgtttgtcaccgagcgcggacacagactcatggagacgcgaggtaagaagcgcatcaaaaagaacgggggaaaactggtttttgaccccgagcagccagagctcacctggctcgtcgagtgcgagaccgtctgcgcccactgcggagcggacgctttcgctcccgagtccgtctttctcgcccccaagctctacgccctgcaatccctcctctgtcccgcctgcgggcgctcttccaagggcaagctccgcgccaagggccacgccgccgaggccctcaactacgagctcatggtcaactgctatctcgccgactcgcagggcgaagaccgtgcccgtttcagcaccagcaggatgagtctcaagcgcacccttgcaagcgcccagccaggggcccaccccttcaccgtgacggagaccaccctcactcggaccctgagaccctggaaggacatgacgctggccgcgctggacgcccatcgtctcgtgccctacagtcgcagtcgtcccaacccccgaaacgaggaagtctgctggatcgagatgccgtag

SEQ ID NO: 927 - DNA, 1047 bp, Adenovirus D9
  MISC_FEATURE (1)..(1047): D9.orf00061 pIVa2 protein
atgcccatggccgacggactcaagcccctgaaaaactttgcttccctgcaagagctcctctcgctgggcggggaccgcctcctcggcgagctcgttcgggaaaacctccaagtcagagacatgctcaacgaggtggcccccctcctccgggacgacggcagctgcatgtccttgaactaccacctgcaacccgtcatcggggtcatctacggcccgaccgggtgcggcaagtcccagctgttgagaaacctgctctcttcgcagctcatcaccccagccccggaaaccgtttttttcatcgccccgcaggtggacatgatccccccctccgagatgaaagcctgggagatgcagatctgtgaggggaacttcgccccggggcccgagggaaccatcgtcccccaatctggcaccctccgccccaaattcattaaaatgtcttatgatgatctcacccaggagcataattatgatgtatctgaccccagaaacgtctttgccaaagccgcagcccacgggcccatcgccatcatcatggatgaatgcatggaaaacctgggcgggcacaagggcgtctccaaattcttccacgcattcccttccaagttgcatgacaagttccccaagtgcacgggctacaccgtcctggtggtcctgcacaacatgaacccccggcgggatctgggtggcaacatcgccaacctcaagatccaggccaaactgcacatcatctccccccgcatgcatccctcccagctcaaccgcttcgccaatacctacaccaaggggctccccgtggccatcagtctccttctcaaagacatcatccagcaccacgcccagcgcccctgctatgactggatcatctacaacacgaccccagagcacgaggccatgcagtggtgctacctccacccccgggacgggctcatgcccatgtacctcaacatccaatcccacctctaccgggtcctggaaaaaatccaccgcactctcaatgatcgggagaggtggaccagggcctaccgcgcgcgaaaaaataaataa

SEQ ID NO: 928 - DNA, 405 bp, Adenovirus D9
  MISC_FEATURE (1)..(405): D9.orf00064 pIX protein
atgaacgggaccggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggagctcgtcgctcgacagcaccgccgcagccgcggcagccgcagctgccatgacagcgacgagactggcctcgagctacatgcccagcagcggcagcagcccctctgtgcccagttccatcatcgccgaggagaaactgctggccctgctggccgagctggaagccctgagccgccagctggccgccctgacccagcaggtgtccgagctccgcgagcagcaacagcagcaaaataaatga

SEQ ID NO: 929 - DNA, 1488 bp, Adenovirus D9
  MISC_FEATURE (1)..(1488): D9.orf00066 E1B 55k E1B 55k protein
atggagccaggacacccaactgagcaggggctacatcctggacttcgcagccatgcacctgtggagggcctggatcaggcagcggggacagagaatcttgaattactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagttaagagggagaggagcgatgggggtaataccgggatgatgaccgagctgacggccagcctgatgaatcggaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttcttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacctgcgattcgggggtctgccatatcctgaagaacatccatgtgacctcccaccccagaaagaagtggccagtgtttgagaataacctgctgatcaagtgccatatgcacctgggagccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattag

SEQ ID NO: 930 - DNA, 207 bp, Adenovirus D9
  MISC_FEATURE (1)..(207): D9.orf00069 E1A 14.9 kDa protein
gtgtcagaggatgagttatcaccctcagaagaagaccacccgtctccccctgagctgtcaggcgaaacgcccctgcaagtgttcagacccaccccagtcagacccagtggcgagaggcgagcggctgttgacaaaattgaggacttgttgcaggacatgggtggggatgaacctttggacctgagcttgaaacgccccaggaactag

SEQ ID NO: 931 - DNA, 543 bp, Adenovirus D9
  MISC_FEATURE (1)..(543): D9.orf00070 E1A 28.2 kDa protein
gtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaggaggctgtgaatttaatatttccagaatctatgattcttcaggctgacatagccaacgaatctactccacttcatacaccgactctgtcacccatacctgaattggaagaggaggacgaactagacctccggtgttatgaggaaggttttcctcccagcgattcagaggatgaacggggtgagcagaccatggctctgatctcagactatgcttgtgtgattgtggaggagcaagatgtgattgaaaaatctactgagccagtacaaggctgtaggaactgccagtaccaccgggataagtccggagatgtgaacgcctcctgcgctttgtgctatatgaaacagactttcagctttatttacagtaagtggagtgaatgtgagagaggctga

SEQ ID NO: 932 - DNA, 126 bp, Artificial Sequence
  D9.orf00071 hypothetical protein
gtgtttttttcgcgaatttccgcgtccgtgtcaaagtccggtgtttatgtcacagatcagctgatccgcagggtatttaaaccagtcgagtccgtcaagaggccactcttgagtgccagcgagtag

SEQ ID NO: 933 - DNA, 378 bp, Adenovirus D10
  MISC_FEATURE (1)..(378): D10.orf00002 E4 14.0 K E4 ORF1 14.0 kDa protein
atggctgaatctctgtatgctttcatagatagtcctggagggatcgctcccgtccaggaagggactagcaatagatataccttcttttgcccagaatctttccacattcctccgcatggggtggtattgcttcacctaaaagtgagtgtgctggttcctactggatatcagggcagatttatggccttgaatgactaccatgccagggacatactaacccagtccgatgtgatttttgccggaagaagacaggaacttactgtgctgctttttaatcacacggaccgatttttgtatgtccgcaagggccacccagtgggtaccctgttgctggagagagtgatttttccttcagtgaaaatagccaccttagtttag

SEQ ID NO: 934 - DNA, 393 bp, Adenovirus D10
  MISC_FEATURE (1)..(393): D10.orf00003 E4 14.5 K E4 ORF2 14.5 kDa protein
atgcttcagcgacgcggtgtaagctaccacattgtggtccctggggtcctagtaacttatttagaggacttttctattacgcaaatgattaaagaaaaactaccacgctttatcactcacattttggaaggcatcaccggagacacaaagagagcttattccagcatgcagtttttgggtgctagctttggagcattaaagttttcccttacgcttgccagtcccacgcttagccctggctctgaattgtcagctgtagtggcccaggacttaagtgactttttgcagctgacattgaggcgcgagctcagggcggagggcagaaccttattgaatcttgttgttttgaacacgctgcaggtggtggagcagcaggatctgtttctattatga

SEQ ID NO: 935 - DNA, 354 bp, Adenovirus D10
  MISC_FEATURE (1)..(354): D10.orf00005 E4 13.6 K E4 ORF 3 13.6 kDa protein
atgaaggtctgcctgattatgaaagtggagggggcactgtgggagcttttccacatgtgcggagtggacttacaccaacaatttgtagagataattcaaggctggaaaaatgagaattacctggggatggtgcaggaatgtaacctgatgattgatgaaatcgatggagggccagcctttaatgtgattcttatgctggatgtacgcgtagagccactgctcgaagccacggtcgagcaccttgaaaatagagtgggttttgacctggctgtctgtttccaccagcacagcggaggggaacgctgtcacctgcgtgacttgcactttatcgtccttcgagaccgtttggaataa

SEQ ID NO: 936 - DNA, 879 bp, Adenovirus D10
  MISC_FEATURE (1)..(879): D10.orf00011 E4 34.1 K E4 ORF6 34.1 kDa protein
atgcaaaccgagattcaatccagctcgctccgccatcatccatatcgcagggcccgtttaccacgatctgatgaggaaaccagggcttcactgactgaacaacatcccctgttgcccgattgtgatcatgcagattatcataatgtaagttctgtccgtggattaccatgtgctgctggctttaccctgctccaagagtttccagtcccctgggatatgatcctgaccccagaggaaataaaaattttaaaaagatgtatgtcagtgtgcctgtgccctgctaccctggacttggtgagagctcagatggtgagcgggtacgagcgctggatcctgcattgccactgttcatccccgggctccctgcagtgtcgggcgggaggcaccctgctggccgtgtggttcaggagagtcatttacgggtgcatgttcaaccagcgcttcccctggtaccgtcagattgtgaacagaaacatgcccaaagagatcatgtatatgggcagtgtgtttatgaggggcaggcacctgatatactgccgcatctggtacgatggtcacgtgggttccatcatccccaacatgagctttggctggagcgccctgaattatgggctgctgaataacatggtgattatgtgctgcacttactgtgagaacatggcagagatcaggatgcggtgctgtgcccgacgcaccaggagactgatgctgaaggctgtggggattatagtcagagagacttgcgatcccgatcccatctgcagcagccgcacagagccccgacggcagagactgctgagggcgctgatggagaggcacagacccatcctgttttccgagtatgaatctgtgcgttcttctcattccaccagactgtga

SEQ ID NO: 937 - DNA, 246 bp, Adenovirus D10
  MISC_FEATURE (1)..(246): D10.orf00013 E4 ORF6/7 protein
gtgaccttggactgtgaggctcgcttggatgacttttcagaggacggcttcatctcaatcaccgacccccgtttggctcgccaggaaactgtgtggattatagaccccaagtccagttcccgcactaatcagaatattgccctatttaaggccacccgtgctgagagaattgtttacactgtgaaatgggctggtggtgggagactgactacccgtgctggtgtaaaaatcaataaagatacatga

SEQ ID NO: 938 - DNA, 1104 bp, Adenovirus D10; identical to SEQ ID NO: 148
  MISC_FEATURE (1)..(1104): D10.orf00014 L5 fiber

SEQ ID NO: 939 - DNA, 150 bp, Adenovirus D10
  MISC_FEATURE (1)..(150): D10.orf00015 U protein
atgaaaattgtggaccaggaatttgacatccctttcaaggtgtggaggaagttcgccgcccgccggggactggagtaccaaagctgggaggagggtaccgaggtgctgctgaacaactacaccagagacatactttcagatttcaagtaa

SEQ ID NO: 940 - DNA, 390 bp, Adenovirus D10
  MISC_FEATURE (1)..(390): D10.orf00018 E3 14.6 kDa protein
atgactgaccacctggacctcgagatggacggccaggcctccgagcagcgcaccctgcaactgcgcgttcgtcagcagcaggagcgggccgccaaggagctcctcgatgccatcaacatccaccagtgcaagaagggtatcttctgcctggtcaaacaggcaaagatcacctacgagctcctgtccggcggcaagcagcatcgcctcgcctatgagctgcctcagcagaagcagaagttcacctgcatggtgggcatcaaccccatagtcatcacccagcagtcgggcgagaccagcggctgcatccactgctcctgtgaaagccccgagtgcatctactccctgctcaagaccctttgcggactccgcgacctcctgcccatgaactga

SEQ ID NO: 941 - DNA, 393 bp, Adenovirus D10
  MISC_FEATURE (1)..(393): D10.orf00020 E3 14.7kDa protein
atgcagactctgctcatgctgctatccctcctatcccctgccctagccacttctgctgattactctaagtgcaaattcgcagacatatggaatttcttagattgctatcaggaaaaaattgatatgccctcctattacttggtgattgtgggaatagtcatggtctgctcctgcactttctttgccatcatgatctacccctgttttgatctcggctggaactctgttgaagcattcacatacacactagaaagcagttcactagcctccacgccaccgcccacaccgcctcctcgcagaaatcagttcccactgatacagtacttagaagagccccctccccgacccccttccactgttagctactttcacataaccggcggcgatgactga

SEQ ID NO: 942 - DNA, 276 bp, Adenovirus D10
  MISC_FEATURE (1)..(276): D10.orf00021 E3 RID-alpha
atgattcctaggttcttcctatttaacatcctcttctgtctcttcaacatctgtgctgccttcgcggccgtctcgcacgcctcgcccgactgtctcgggcccttcccaacctacctcctctttgctctgctcacctgcacctgcgtctgcagcattgtctgcctggtcatcaccttcctgcagctcatcgactggtgctgcgcgcgctacaattatctccatcacagtcccgaatacagggacgagaacgtagccagaatcttaaggctcatctga

SEQ ID NO: 943 - DNA, 792 bp, Adenovirus D10
  MISC_FEATURE (1)..(792): D10.orf00023 E3 CR1-gamma
atgaaggctttcacagcttgcgttctgattagcctagtcacacttagttcagctgcaggatatactcaagttaatgttactagagatggtagtataaatcttaaaggaccatacactaataccacatggtccagatttcacttgaacgcatggcaatttatttgcacatggaatgtgacagcatatgtatgtcacaaaaatggaagcattaccatcacagctcaaaagaacataacttctggagtattgaaagccgatgggtttcatgtaaattcatatggatatgaaaatcaaaaactgattttatataatttaacaatcattgagcatccaaccactaaagcgccaactactactaggcccaccacaattaggtcaaccatggaaacaaccacgcagcctaccactactcatactacacagatagacacaacactacagaatactactttattaattggatttttactgagagagaatgaaagtactactgatcagacagaggctacctcaagtgccttcagcagcactgcaaatttaacttcgcttgcttggactaatgaaaccggagtatcattgatgaatcgtcagcctttctcaggtttggatattcaaattacttttctggttgtctgtgggatctttattcttgcggttcttctgtactttgtctgctgcaaagccagagagaaatctaggaggcccatctacaggccagtaatcggggagcctcagcccctccaagtggatggaggcttaagaaatcttctcttctcttttacagtatggtga

SEQ ID NO: 944 - DNA, 1272 bp, Adenovirus D10
  MISC_FEATURE (1)..(1272): D10.orf00024 E3 CR1-beta
atgaatacagtgttccgtatcgtgctgctctctcttcttgtagctttcggtcaggcaggaattcatattattaatgctacatggtgggataatataactttagtgggaccctcagatactccagttacctggtatgatggcaatggattgcaattttgtgacggaagtacagttaagaatccgcagataagacatacttgtaatgatcaaaacttaactctgattcatgttaacaaaacccatgaaagaacatacatgggttacagacatgacagtaagggaaaagtagactataaggttacagtcattccacctcctcctgctactgtaaagccacaaccagatccagaaaatgtctttgtttatatgggagataatgtaactttagttggacctccaggaattccagttagttggtattatcataatggcacacagttctgcgatggagataaaattattcatccagaattcaaccacacctgtgataaacaaaaccttacactgctgtttgtaaactttacacatgacggaggctatcttggattcaattacaaaggtactaaaagaactcagtatgaggttatagttttagatcgatttccaaattctggtcagatgaaaattgaagaacaaagtgaggaaacagaacagaaacatactgagcaaaataaggctggacaaaagcagggtatagatacaaatcaaaagaaatctaataacagacaaaagccatctcaaaggccatcaagaagacggccgacaaacactcctgagacaaaacaacttacagtgtctattgggtctaacttaactttagttggtccagatggaaaagtcacttggtatgatggtgatttaaaaagaccatgtgaagaacaaaactataggcttccacatcagtgtagtactcagaacttaactttaattaatgtaactaaatctcatgagggaacttactatggcactaatgacaaagacgaaagcaaaagatacagagtgaaagtgaacactacaaattctcaagctgtaaaaattaacccatataccagacctactactcctgatcagaaacacagatttgaattgcaaattgaaaataatgcaaatgatgaagaatcaaaaattccatctactactgtggcaatcgtggtgggagtgattgcgggcttcataactataatcattgtcattctgtgctacatctgctgccgcaagcgtcccagggcatacaatcatatggtagacccactactcagcttctcttactga

SEQ ID NO: 945 - DNA, 471 bp, Adenovirus D10
  MISC_FEATURE (1)..(471): D10.orf00028 E3 gp 17.6 kDa protein
atgaaggggctcttgctgattatcctttccctggtggggggtgtgctgtcatgccacgaacagccacgatgtaacatcaccacaggcaatgagaggaacgactgctctgtagttattaaatgcgagcaccattgtcctctcaacatcacattcaagaataagaccatgggaaatgtatgggtgggattctggcaaccaggagatgagcagaactacacggtcactgtccatggtagcgatggcaatcacactttcggtttcaaattcatttttgaagtcatgtgtgatatcacactacatgtggctagacttcatggcttgtggccccctaccaaggagaacatggtgggtttttctttggcttttgtgatcatggcctgcttgatgtcaggtctgctggtaggggctctagtgtggtttctgaagcgcaagcccaggtacggaaatgaggagaaggaaaaattgctataa

SEQ ID NO: 946 - DNA, 567 bp, Adenovirus D10
  MISC_FEATURE (1)..(567): D10.orf00029 E3 CR1-alpha
gtggtgagtttaataaaagctaaactcttgcaatactctggaccttgtcgtcatcaactcaacgagaccgtctacctcaccaaccagactgaggtaaaactcacctgcagaccacacaagacctatatcatctggttcttcgagaacacctcatttgcagtctcaaacactcactgcaacgacggtgttgaacttccaaacaacctttccagtggactgagttacgatacacatagagctaagctcgtcctctacaatcctttcgtagagggaacctaccactgccagagcggaccttgcttccacagttttactttggtgaacgttaccggcagcagcacagccgctccagaacctaaccttccttctgatactatcaaacctcgtttcggaggtgagctaaggcttcccccttctgaggagggggttagcccatacgaagtggtcgggtatttgattttaggggtggtcctgggtgggtgcatagcggtgctagctcagctgccttgctgggtggaaatcaaaatctttatatgctgggtcagacattgtgggaaggaactatga

SEQ ID NO: 947 - DNA, 321 bp, Adenovirus D10
  MISC_FEATURE (1)..(321): D10.orf00030 E3 12.2 K E3 12.2 kDa protein
atgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccgaccccgaagtcgcatgagaatttttgctgtactctttgtggtgagtttaataaaagctaa

SEQ ID NO: 948 - DNA, 684 bp, Adenovirus D10
  MISC_FEATURE (1)..(684): D10.orf00031 L4 pVIII
atgagcaaggagattcccaccccttacatgtggagctatcagccccagatgggcctggccgcgggcgcctcccaagactactccacccgcatgaactggctcagtgccggcccctcgatgatatcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactga

SEQ ID NO: 949 - DNA, 186 bp, Adenovirus D10
  MISC_FEATURE (1)..(186): D10.orf00033 L4 22 kDa protein
gtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaa

SEQ ID NO: 950 - DNA, 2199 bp, Adenovirus D10
  MISC_FEATURE (1)..(2199): D10.orf00035 L4 100 kDa protein
atggaggagcagccgcgtaagcaggagcaggaggaggacttaaccacccacgagcaaccaaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctcaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacatgcgagcccaacccgcgtctcaacttctatcccgtctttgcggtccccgaggccctcgccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggtgacaacgccaggctggccgtgctcaagcgcagcgtcgagctcacccactttgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgagccccaggctttggaacagcggcgcaagctcatgctggccgtggtcctggtcaccctcgagctcgaatgcatgcgccgcttcttcagcgaccccgagaccctgcgcaaggtcgaggagaccctgcactacactttcagacacggtttcgtcaggcaggcctgcaagatttccaacgtggagctgaccaacctggtctcctgcctggggatcctgcatgagaaccgcctgggacagaccgtactccactctaccctcaagggcgaggcgcggagggactatgtccgcgactgcgtctttctctttctctgccacacatggcaagcagccatgggcgtgtggcagcagtgtctcgaggacgagaacctgaaggaactggacaagcttcttgctagaaaccttaaaaagctttggacgggcttcgacgagcgcaccgtcgcctcggacctggccgagatcgtcttccccgagcgcctgaggcagacgctgaaaggcgggctgcccgacttcatgagccagagcatgttgcaaaactaccgcactttcattctcgagcgatcggggatgctgcccgccacctgcaacgctttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctccttagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgcagctccggccaagcctcctcgtag

SEQ ID NO: 951 - DNA, 1470 bp, Adenovirus D10
  MISC_FEATURE (1)..(1470): D10.orf00036 E2A DNA-binding protein
atggccggcggcagtcaggacgtgcgccggttcatggaccgagaggccactccgccccggggccacggttcagcgcgctatccgccggagcaggagaggagcccctcgccgccacctcctctgccaaccaagcgccgaaagtatcagcgggtgggatccgggtcttccgaggaggacgtggtccccgtggacagccctccaaaaaagaagcaagccagaaagaccaagcatgtgaccaaggtagacccagacgaagagatgccccaggaagaagccgtgatcgtgggagtgggattcagccagccgccggttctgttgaaggaaggcaaggacggaaaacgcatcgtcgagcccgcgacccccggtgtcctgaacgtgcgcaaccccctgagtctgcctctggtctcgtcctgggagaagggcatggataccatgaatgtgctgatggaacgctaccgcgtcgacagcggcctgcgcgatgcttacaagctcatgcccgagcagaccgagatcttccaaaagatgtgccagacctggatgaacgaggaggcccgcggtctgcaactgaccttcaccacccagaagagctttagcaccatcatgggtcgcctgttgcaaggttacatcttcagccacagcgggatcgcgcacaagaactgggagtgcaccggcagtgccctgtgggaccacggctgcaccgaggtggaaggccagctcaagtgtctgcatgggacggtgatgatccacaaggaccacgtggtggagatggatgtgaccagtgagaacgggcagcgtgcgctgaaggagcaacccagcaaggccaaggtgacccagaaccgctggggacggagcgtggtgcaactgaccagccatgacgcgcgctgctgcgtccatgatgccgggtgcgggaataatcagttcagcgggaagagctgcggcctgtttttcagcgagggggccaaggcccagcaagctttcaagcagatcgcggccttcgtcaaggccctctacccgaatatgcagcgcggcgcggggatgatgctgatgcccgtgcactgcgagtgtaaccacaagcctcagagcgtgcccttcctgggccgccagctgtgcaagatgaccccgttcggcctgagcaacgccgaggacctggacaaggatcagatcagcgacaagagcgtgctggctagtgtgaagtaccccagtctgatggtgttccagtgctgcaacccagtgtaccgcaactcgcgcgcgcagagcaccggccccaactgcgatttcaagatctccgcgcctgacatgctgggcgccctgcagatgagccggcgcatgtggagcgagaccttccccgagaccccagtgcccaaactggtgatccccgagttcaagtggcagcccaagtaccagttccgcaacgtggccctccccagcgcggcgcacaacgacgagcgcgagaaccccttcgacttttaa

SEQ ID NO: 952 - DNA, 630 bp, Adenovirus D10
  MISC_FEATURE (1)..(630): D10.orf00038 L3 23.6 kDa protease
atgagcggctccagcgaaagagagctcgcggccatcgtgcgcgacctgggctgcgggccctactttttgggtacccacgacaagcgcttcccgggcttccttgccggcgacaagctggcctgcgccatcgtcaacacggccggccgcgagaccgggggcgtgcactggctcgccttcggctggaacccgcgctcgcgcacctgctacatgttcgacccctttgggttctcggaccgccggctcaagcagatttacagcttcgagtacgaggccatgctgcgccgaagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctccggcgcaaccaggaggagctctaccgcttcctcgcgcgccactccccttactttcgctcccaccgcgccgccatcgaacacgccaccgcttttgacaaaatgaaacaactgcgtgtatctcaataa

SEQ ID NO: 953 - DNA, 2880 bp, Adenovirus D10; identical to SEQ ID NO: 208
  MISC_FEATURE (1)..(2880): D10.orf00041 L3 hexon

SEQ ID NO: 954 - DNA, 705 bp, Adenovirus D10
  MISC_FEATURE (1)..(705): D10.orf00042 L3 pVI
atggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgctaagggaaaagctcaaagaccagaactttcagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaaaggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgttgcacagtatcgtaggcctgggagtgaaaagtctgaagcgccgccgatgctattga

SEQ ID NO: 955 - DNA, 117 bp, Adenovirus D10; identical to SEQ ID NO: 919
  MISC_FEATURE (1)..(117): D10.orf00043 L2 pX core protein L2 pX

SEQ ID NO: 956 - DNA, 1005 bp, Adenovirus D10
  MISC_FEATURE (1)..(1005): D10.orf00045 L2 pV
atgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaa

SEQ ID NO: 957 - DNA, 585 bp, Adenovirus D10
  MISC_FEATURE (1)..(585): D10.orf00046 L2 pVII major core protein L2 pVII
atgtctattctcatctcgcccagcaataacaccggctggggtcttactagacccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgtcatcgactcggtggtcgccgacgcgcgcaactacactcccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctga

SEQ ID NO: 958 - DNA, 1560 bp, Adenovirus D10; identical to SEQ ID NO: 178
  MISC_FEATURE (1)..(1560): D10.orf00048 L2-pIII penton

SEQ ID NO: 959 - DNA, 1596 bp, Adenovirus D10
  MISC_FEATURE (1)..(1596): D10.orf00051 L1 pIIIa L1 pIIIa 62.1 kDa protein
atgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggttccccagagcgaggtgtaccagtctggcccggactactttttccagacgagccggcagggcttgcagacggtgaacctgagccaggctttcaagaacctgcgcgggctgtggggcgtgcaggcgcccgtgggcgaccggtcgacggtgagcagcttgctgacgcccaactcgcgtctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaacttcttgctgaccaatagacagcagaagatcccggcgcaatatgcgctgtcggccgaggaggaaaggatcctgagatatgtgcagcagagcgtagggctgttcctgatgcaggagggggccacccccagcgccgcgctggacatgaccgcgcgcaacatggaacctagcatgtacgccgccaaccggccgttcatcaataagctgatggactacctgcaccgcgcggcggtcatgaacacggactactttacaaacgccatcctgaacccgcactggctcccgccgccggggttctacacgggcgagtacgacatgcccgaccccaacgacgggttcctgtgggacgacgtggacagcgtggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccacgggccaagaacgccatggccaataacggtatagagagtctggtggacaaactgaaccgttggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttga

SEQ ID NO: 960 - DNA, 1119 bp, Adenovirus D10
  MISC_FEATURE (1)..(1119): D10.orf00055 L1 52 kDa protein
atgcatcccgtcctgcgccaaatgcgtcccacccccccggcgaccaccgcgaccgcggccgtagcaggcgccggcgctagccagccacagacagagatggacttggaagagggcgaagggctggcaagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgaacagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcactgctgaacatcgccgagcccgagggtcgctggctgctggagctgatcaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctaagcgaccgcgagctgatgctgagccttcgccgggcgctggtagggggcgctgccggcggcgaggagtcctacttcgacatgggggcggacctgcattggcagccgagccggcgcgccttggaggccgcctacggtccagaggacttggaagaggatgaggaagaggaggaggatgcacccgctgcggggtactga

SEQ ID NO: 961 - DNA, 1854 bp, Adenovirus D10
  MISC_FEATURE (1)..(1854): D10.orf00058 pTP
atggactatttcctgccgctgcgcaacatctggaaccgcgtccgcgagttcccgcgcgcctccaccaccgccgccggcatcacctggatgtcccgctacctctacggctaccaccgcctcatgctcgaggacctggccccgggcgcgccggccacccagcgctggccgctctaccgccagccgccaccgcacttcctagtcggctaccagtacctcgtgcgcacctgcaacgactacgtcttcgactcgcgcgccttctcgcggatcaggtactccgaggtcgtgcaacccggcctgcagaccgtcaactggtcgctcatggccaactgcacctacaccatcaacaccggggcctaccaccgcttcgtcgacatggatgacttccaggacaccctcacccgcgtgcaacaggccatcctcgccgagcgcgtcgtcgccgacctggcgctcgtgcagccgctcaggggcgtcggggtcacccgcatggaagactccgcctccgccagtgatgacattgagaggctcatgcatgactactacaagaacctgagccggtgtcagggccaggcctggggcatggccgagcggctccgcatccagcaagcgggacccaaggacctggtcctcctcgccaccatccgccgcctcaaaaacgcctacttcaattacatcatcagcaaccgcaattctaacagcgtccacagggctgctacgtgtttgagcttaccttgcgactgcgattggctagacgctttcctcgaaagattctccgatccggtcgatctcgacgcgctcacgtcccctacaccgcaattgataagatgcatcgtcagcgccctatcgctgcccaacggggacccgccccattaccgggagatgaccggcggcgtcttcacgctgcgtcctcgcgaacggggtcgcgccgtcaccgaaaccatgcgtcgccgccgcggggagatgatcgagcgcttcgtcgaccgtctcccggtgcgtcgccgtcgtcgtcgggccccgccaccaccaccgcccccagaggaagaaatagaagaagaggtcgtcatggaagaagaggaagaagaggaggcccccggggatttcgagcgcgaggtgcgcgccaccatcgccgagctcatcaggctcctggaagacgagctcacggtctcggcccgcaatgcccagtttttcaacttcgccgtggatttctacgaggccatggaaaggctggaggccatcggcgacatcagcgagatgcccctgcgccgctggatcatgtacttcttcgtcaccgagcacatcgccaccaccctcaactacctcttccagcgcctgcgcaactacgccgtcttcacgcggcacgtggagctcaacctcgcgcaggtggtcatgcgcgcacgcgacgccgacggggacgtggtctacagccgcgtctggaacgagagcggcctgggcgccttctcgcagctcatgggccgcatctccaatgacctcgccgccaccgtggagcgcgcgggccgcggcgatctccaggaggaggagatcgaacagttcatgtccgagatcgcctaccaggacaactcgggcgacgtgcaagagatcctgcgtcaggccgccgtcaatgacgcagagattgattctgttgaactgtctttcaggttcaaagtcacggggcccgtggtcttcacgcagaggcggcagatccaggatgtcaaccgccgcgtcgtcgcgcacgccagcgctctcagggcgcagcaccgggacctgcccgagcgccacgccgacgtgcctctgccgcccctgcccgcggggccggaaccgccgctgccgccgggagcgcgtccgcgacaccgcttctaa

SEQ ID NO: 962 - DNA, 3300 bp, Adenovirus D10
  MISC_FEATURE (1)..(3300): D10.orf00062 E2B DNA polymerase
gtggccccgcgcagctacgggctcatgcaatgcgtggacacgaccaccaactcacccgtggagatcaagtaccatctgcatctcaagcacgccctcacccgcctctacgaggtcaacctcagaaccctgcccccggacctggatctccgcgacaccatggacagctcccaactgcgcgccctcgtcttcgctctccgcccccgccgcgccgagatctggacctggctcccgcgcgggctcgtcagcctctccgtcctcgaggagccccagggtgagtcccacgcaggcgaacatgaaagccaccagccagggccgccactcctgaagttcctcctcaagggacgcgctgtgtatctcgtggatgaggtacagcccgtgcagcgctgcgagtactgcggacgcttttacaagcatcagcacgagtgctcggttcgccggcgggatttctactttcatcacatcaacagccactcgtccaactggtggcaggaaatccagttcttcccaatcggctctcatcctcgcacggagcggctctttgtcacctacgatgtagaaacctacacctggatggggtccttcggcaagcagctcgtccccttcatgctggtcatgaaattctcgggggaacccgagctggtcgccctcgctcgcgatctcgccgtgcgcttacgctgggatcgctgggagcgggaccccctcaccttctactgcgtcaccccagaaaagatggccgtgggccagcagttccgcctctttcgcgacgagctccagaccctcatggcccgcgagctctgggcttccttcatgcaagccaacccacatctccaggagtgggcgctcgagcagcacggcctgcaatgccccgaggacctcacctacgaggagctcaaaaagctgccgcacatcaaaggccgcccgcgattcatggaactctacatcgtcgggcacaacatcaacggcttcgacgagatcgtccttgccgcccaggtgatcaacaaccgagcctccgtcccgggccctttccgcatcacccgcaatttcatgccgcgagcaggcaagattctcttcaatgacgtcactttcgctctgcctaaccccctctcgaagaagcgcaccgatttcgagctctgggagcacggcggctgcgacgactcggatttcaagtaccagttcttgaaagtcatggtcagggacaccttcgccctgacgcacacctcgctccgcaaggccgcacaagcttacgccctccccgtggagaagggctgctgtccctacaaggccgtgaaccatttctacatgctgggctcttaccgtgcggacgatcgaggattcccgctccgggagtactggaaggatgacgaggagtacgccctcaaccgcgagctgtgggagaagaaaggagaagcgggttatgacatcatccgcgaaacgctggactactgcgccatggacgtcctcgtcaccgccgagctcgtcgccaagctgcaagactcctacgcgcacttcatccgcgactcggtccgcttgccccacgcccactttaacatcttccaacggcccaccatctcctccaactcgcatgccatctttcgccagatcgtcttccgcgccgagcagccccagcgcaccaatctcggccccgccttcttggccccctcgcatgagttgtatgactacgtgcgcgccagcatccgcggggggcgctgttatcccacctacatcggcatcctctcggagcccatctatgtctatgacatctgcggcatgtacgcctccgccctcacgcatcccatgccctggggtccgccccttaacccctacgagcgagcgctggccgcccgcgagtggcagatggccttggatgatgcatcctcaaaaatagattattttgacaaggaactctgtccgggcatcttcaccatcgatgcggacccccctgacgagcatctgcttgatgtgctgccaccgttctgctcgcgcaagggcggcagactctgctggaccaacgagcccctgcgcggcgaggtggccaccagcgtggacctggtcaccctgcataaccgcggctggcgcgtcaggatcgtgcccgacgagcgcaccaccgtcttcccggaatggaagtgcgtcgcgcgcgagtatgtccagctcaacatcgcggccaaggagcgcgccgaccgtgacaaaaatcagacaatgagatccatcgccaagcttctctccaacgccctctatggctccttcgccaccaagcttgacaataaaaaaattgtcttttctgaccagatggatgaaagtctcctaaaaagcatcgcggcagggcaggccaacatcaaatcctcctcgtttctagaaactgacaacctgagtgccgaggtcatgcccgctctcgagagggaatacctaccccaacagctggcgctcgtggacagcgacgcggaagagagtgaggacgagcacagacccgcccccttttatacccccccgtcggggacccccggtcacgtggcctacacctacaagccaatcaccttcttggatgcggaggagggggacatgtgtctgcacacggtggaaaaggtggaccccctggtggacaacgaccgctacccctcgcacgtggcctcctttgtcttggcgtggacgcgcgcctttgtctcagagtggtccgagtttctctacgaggaggaccgcgggacgcccctgcaggacaggccaatcaagtccgtctacggggacaccgacagcctgtttgtcaccgagcgcggacacagactcatggagacgcgaggtaagaagcgcatcaaaaagaacgggggaaaactggtttttgaccccgagcagccagagctcacctggctcgtcgagtgcgagaccgtctgcgcccactgcggagcggacgctttcgctcccgagtccgtctttctcgcccccaagctctacgccctgcaatccctcctctgtcccgcctgcgggcgctcttccaagggcaagctccgcgccaagggccacgccgccgaggccctcaactacgagctcatggtcaactgctatctcgccgactcgcagggcgaagaccgtgcccgtttcagcaccagcaggatgagtctcaagcgcacccttgcaagcgcccagccaggggcccaccccttcaccgtgacggagaccaccctcactcggaccctgagaccctggaaggacatgacgctggccgcgctggacgcccatcgtctcgtgccctacagtcgcagtcgtcccaacccccgaaacgaggaagtctgctggatcgagatgccgtag

SEQ ID NO: 963 - DNA, 1047 bp, Adenovirus D10; identical to SEQ ID NO: 927
  MISC_FEATURE (1)..(1047): D10.orf00063 pIVa2 protein

SEQ ID NO: 964 - DNA, 405 bp, Adenovirus D10; identical to SEQ ID NO: 928
  MISC_FEATURE (1)..(405): D10.orf00066 pIX protein

SEQ ID NO: 965 - DNA, 1488 bp, Adenovirus D10; identical to SEQ ID NO: 929
  MISC_FEATURE (1)..(1488): D10.orf00068 E1B 55k E1B 55k protein

SEQ ID NO: 966 - DNA, 207 bp, Adenovirus D10
  MISC_FEATURE (1)..(207): D10.orf00072 E1A 14.8 kDa protein
gtgtcagaggatgagtcatcaccctcagaagaagaccacccgtctccccctgatctcacagatgacacgcccctgcaagtgcacagacccaccccagtcagagccagtggcgagaggcgagcagctgttgaaaaaattgaggacttgttacatgacatgggtggggatgaacctttggacctgagcttgaaacgccccaggaactag

SEQ ID NO: 967 - DNA, 543 bp, Adenovirus D10
  MISC_FEATURE (1)..(543): D10.orf00074 E1A 28 kDa protein
gtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaggaggctgtgaatttaatatttccagaatctatgattcttcaggctgacatagccaacgaatctactccacttcatacaccgactctgtcacccatacctgaattggaagaggaggacgaactagacctccggtgttatgaggaaggttttcctcccagcgattcagaggatgaacggggtgagcagaccatggctctgatctcagactatgcttgtgtgattgtggaggaacaagtagtgattgaaaattctaccgagccagtggagggctgtagaaaatgccagtaccaccgggataagtctggagacccgaacgcatcatgcgctttgtgctatatgaaacagactttcagctttatttacagtaagtggagtgaatgtgagagaggctga

SEQ ID NO: 968 - DNA, 126 bp, Artificial Sequence; identical to SEQ ID NO: 932
  D10.orf00075 hypothetical protein

SEQ ID NO: 969 - DNA, 378 bp, Adenovirus D13
  MISC_FEATURE (1)..(378): D13.orf00002 E4 ORF1 protein
atggctgaatctctgtatgctttcatagatagtcctggagggatcgctcccgtccaggaagggactagcaatagatataccttcttttgcccagaatctttccacattcctccgcatggggtggttttgcttcacctgagagtgagcgtgctgattcctaatggctaccaaggcagatttatggccttgaatgactaccataccagcggcatactaacccagtccgatgtgatttttgccgggagaagacaggagctagctgtgctgctctttaaccacacggaccgatttttgtatgtccgcgagggccacccagtgggcacactgttgcttcagagagtgatttttccttcagtgagactggccactctggtttag

SEQ ID NO: 970 - DNA, 393 bp, Adenovirus D13
  MISC_FEATURE (1)..(393): D13.orf00003 E4 ORF2 protein
atgcttgagcgccacggtgtcagctaccacattgtggtacctggtgttttagtcaactatttagaggacttttccattactgcaatgattagaaaagagctacctcgctttattactcacctattggaaggcatcaccggagacacaaagagagcttattccagcatgcagtttttgggggctaattatggagcactgaaatattccctcacgcttgccagtcccacgcttagcccaggctcagagttggcagctgtggtgtctgaggacttgagtgactttttacagctgacgctgaggcgcgagctgagggcagagggcagaacctcattaaatcttgctattttgaacacgctgcaggtggtggagcagcaggatctgtttctaatatga

SEQ ID NO: 971 - DNA, 354 bp, Adenovirus D13
  MISC_FEATURE (1)..(354): D13.orf00005 E4 ORF3 protein
atgaaggtctgcctgattatgaaagtggagggggcgctgtgggagcttttccacatgtgcggagtggacttacaccaacaatttgtagagataattcaaggctggaaaaatgagaattacctggggatggtgaacgagtgtaacctgatgattgatgaaatcgatggagggccggcctttaatgtgattcttatgctggatgtacgcgtagagccactgctcgaagccacggtcgagcaccttgaaaatagagtgggttttgatctggctgtctgtttccaccagcacagcggcggggaacgctgtcacctgcgtgatttgcactttatcgtccttcgagaccgcttggaataa

SEQ ID NO: 972 - DNA, 270 bp, Adenovirus D13
  MISC_FEATURE (1)..(270): D13.orf00007 E4 ORF4 protein
atgaggggaattcgcatggacgggttttttgtttcatcagatgcagaggaacttctccagaatcttcgagaatggatgtacttcagttggatgactgagcggcagcagcgaaaggacggccgcaggaggggtatctgctgttcaagggcccatttctgctggcagaagtacgacaaggtacgcaagagaatccactacaatgcaaaccgagattcaatccagctcgctgcgccatcatccatatcgcagggcccgtttaccacgatctga

SEQ ID NO: 973 - DNA, 663 bp, Adenovirus D13
  MISC_FEATURE (1)..(663): D13.orf00008 E4 34.1 kDa protein
atgatcctgaccccagaggaaataaaaattttaaaaagatgtatgtcagtgtgcctgtgccccgctaccctggacttggtgagagctcagatggtgagcgggtacgagcgctggatcctgcattgccactgttcatccccgggctccctgcagtgtcgggcgggaggcaccctgctggccgtgtggttcaggagagtcatttacgggtgcatgttcaaccagcgtttcccatggtaccgtcagattgtgaacagagacatgcccaaagagatcatgtatatgggcagtgtgtttatgaggggcaggcacctgatatactgccgcatctggtacgatggtcacgtgggttccatcatccccaacatgagctttggctggagcaccctgaattatgggctgctaaataacatggtgattatgtgctgcacttactgtgagaacatggcagagatcaggatgcggtgctgtgcccgacgcaccaggagactgatgctgaaggctgtggggatcatagtcagagagacttgtgatcccgatcccatctgcagcagtcgcaccgagccccggcggcaaagactgttgagggcgctgatggagaggcacagacccatcctgttttccgagtatgaatctgtgcgttcttctcgttccaccagactgtga

SEQ ID NO: 974 - DNA, 246 bp, Adenovirus D13
  MISC_FEATURE (1)..(246): D13.orf00009 E4 ORF6/7 protein
gtgaccttggactgtgaggcccgcttggatgacttctcagaggacggcttcatctcaatcaccgacccccgtttggctcgccaggaaactgtgtggattatagacactaaatctagttcccgttccaataataatattcccctatttaaggccacccgtgctgaaagaatcgtgtacactgtgaaatgggctggtggtgggagactgactacccgtgctggtgtaaaaatcaataaagattcataa

SEQ ID NO: 975 - DNA, 1146 bp, Adenovirus D13; identical to SEQ ID NO: 149
  MISC_FEATURE (1)..(1146): D13.orf00011 L5 fiber

SEQ ID NO: 976 - DNA, 150 bp, Adenovirus D13
  MISC_FEATURE (1)..(150): D13.orf00012 U protein
atgaaaattgtggaccaggaatttgacatccctttcaaggtgtggaggaagttcgccgcccgccggggactggagtatcagagctgggaggagggtaccgaggtgctgctgaacaactacaccagagacatactttcagatttcaagtaa

SEQ ID NO: 977 - DNA, 390 bp, Adenovirus D13
  MISC_FEATURE (1)..(390): D13.orf00014 E3 14.5 kDa protein
atgactgaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcatcaaccccatagtcatcacccagcagtcgggcgaggccagcggctgcatccactgctcctgcgaaagccccgagtgcatctactccctactcaagaccctttgcggactccgcgaccttctccccatgaactga

SEQ ID NO: 978 - DNA, 393 bp, Adenovirus D13
  MISC_FEATURE (1)..(393): D13.orf00017 E3 RID-beta
atgcagactctgctcatactgctatccctgctcctatcccctgccctcgctgatgatgattactctaagtgcaaatttgtgaagctatggaatttcttagactgctatgatgctaaaatggatatgccatcctattacttggtgattgtggggatagtcatggtctgctcctgcactttctttgccatcatgatctacccctgttttgatctcggctggaactctgttgaggcattcacatacacactagaaagcagttcactagcctccacgccaccacccacacctcctccccgcagaaatcagtttcccctgattcagtacttagaagagccccctccccgacccccttccactgttagctactttcacataactggcggcgatgactga

SEQ ID NO: 979 - DNA, 276 bp, Adenovirus D13
  MISC_FEATURE (1)..(276): D13.orf00018 E3 RID-alpha
atgattcctaggttcttcctatttaacatcctcttctgtctcttcaacatctgcgctgcctttgcggccgtctcgcacgcctcgcccgactgtctcgggcccttccccacctacctcctctttgccctgctcacctgcacctgcgtctgcagcattgtctgtctggtcgtcaccttcctgcagctcatcgactggtgctgcgcgcgctacaattacctacaccacagtcccgaatacagggacgagaacgtagccagaatcttaaggctcatatga

SEQ ID NO: 980 - DNA, 870 bp, Adenovirus D13
  MISC_FEATURE (1)..(870): D13.orf00020 E3 CR1-gamma
atgaaggctttaacagcttttggtctgatcttaatcacactaagctacactgctgcagctgcttgctattataatcttaatgtaaccagaggagaaaatattacactctcaggagcaggaattaatactacatggacagcttatcataatagtggaaatggaggaaaacatggatggttgccaatctgcacatggggcgatgggcgctatctgtgcaatggcaacagcagtactatttctaatcttacatttgtagcaagcagaaattcttctgacagaaattttaaggcagagagttatactaataatgatgattatgaagttgtaaaatcatgttattataatgttaaaatcattgagcttccaaccactagagcacccaccacagttaggtcaactacacagtcctctactaaagagacaacacagcctaccactgtgcccactacacaaccaaccaccacagccagtacaactattgagaccactactcacactacacacctagacacaacagtacagaatagtactgtgttggttaggtttttgttgagggaggaaagtactactgaacagacagaggctacctcaagtgccttcagcagcactgcaaatttaacttcgcttgcttcaataaatgagaccctcgtgccgttgatgctggaacaagatctaagaggtttggatatgcaaattacttttctggttgtatgtgggatctttattcttgtggttcttctgtactttgtctgctgtaaagccagagagaaatctaggcggcccatctacaggccagtaatcggggaacctcagccgctgcaagtggaagggggtctaaggaatcttctcttctctttttcagtatggtga

SEQ ID NO: 981 - DNA, 1236 bp, Adenovirus D13
  MISC_FEATURE (1)..(1236): D13.orf00021 E3 CR1-beta
atgaatactttgaccagtgtcgtgctgctctctcttcttgtggtttttagtcagggacaaatagaacatgaaaaacagagtgttcagtggggaaagaacataacgcttgtgggtcctaacgataagcctgttgaatggcatgggcctagagatcagctttgtaagggaaaacaaatttttcacccagaattcaatcacacatgtaatgaacaaaacctcacactgctgtttgtgaacaacactttccagggaaaatattatggctttagaaatgatggtaaaggtatgaaacaaattgaactaacagtagtcccacctcctgcctcaacacgcaaacctttgtcaaagccaaaacaagtcaatgtccaatatggacataatgtaacattagaaggtcctccaggaatacctattgactggcttggaccaactaatcagctttgtaaaggaaaacaaattttacatccagaaataaaccacacctgcaatgttcaaaatctaacactgctatttgtaaactacactcatcgcggagcgtattttggctttaacaaagacggaactgataggcaacactatgaagttactattctagatggcttcagagatgcagggcagacaaaagatgagacagacagtcataaaacaaaaggaaaaacttcttcaaaacagaaaaaaacacaaaaaaataactctcatagaaatgatgatgttaaagagttagattttccaagtggatctaatcaaactttaattggtcctcctggttcaaaagttgattggtacacaacaaaaaatggtgactttacaaaattgtgcgatggattgaacggtccaaagaatctgtgtaattatcagaacttgacattgcgaaatgtaagcagacaggatgaaggaacttattttgggtctaatgaacagtcaaagcattacagagttactgtctatacaaaacctagaaatcaaactaaaagaattcagccatatactactaagggaactaccaaaggaactacaaaattaacctcaggtaatcacagctttgaattgcaactggcagatgatcaatctaatcaacaggatcaacaaattccatcaactaccgtggcaatcgtggtgggtgtgattgcgggcttcataactctgatcattgtcattctgtgctacatctgctgccgcaagcgtcccagggcttacaataatatggtagacccactactcagcttctcttactga

SEQ ID NO: 982 - DNA, 261 bp, Adenovirus D13
  MISC_FEATURE (1)..(261): D13.orf00023 E3 gp 17.7 kDa protein
atgcagtgtgatatcacacatgacttcaaaaatgaatttgaaaccgaaagtgtgttttccatcgctaccatggacagtgaccgtgtagttctgctcatctcctggttcccaatcacccacccatacatttcccatggtcttattcttgaatgtgatgttgagaggacattcatgctcgcatcttatgattactgtacatatcacactcctctcattgcctgtggtaatgttacatcgtggctgttcgtggcaggccagtaa

SEQ ID NO: 983 - DNA, 192 bp, Adenovirus D13
  MISC_FEATURE (1)..(192): D13.orf00024 E3 gp 17.6 kDa protein
atgtgtgatatcacactgcatgtggctagacttcatggcttgtggccccctaccaaggagaacatggttgggttttctttggcttttgtgatcatggcctgcttgatgtcaggtctgctggtaggggctctagtgtggttcctgaagcgcaagcccaggtacggaaatgaggagaaggaaaaattgctataa

SEQ ID NO: 984 - DNA, 594 bp, Adenovirus D13
  MISC_FEATURE (1)..(594): D13.orf00025 E3 CR1-alpha
atgagaatttttgctgtactctttgtggtgagtttaataaaagctaaactcttacaatactctggaccttgtcgtcgtcaactcaacgagaccgtctacctcaccaaccagactgaggtaaaactcaactgcagaccagggggcaaatatatcatctggctctttgagaacacttccttcgcagtctccaacacccactgcaacgacggtattgaaatacccaacaaccttaccagtggactaacttacaccaccagaaagactaagctagtactctacaatccttttgtagagggaacctaccactgcaagagcggatcttgctaccacactttcactttggtgaacgttaccggcagcagcacagccgctcctgaaacaactaacctttcttctgatactaacaaacctcgtgtcggaggtgagctttgggttccctctctaacagagggtgggagtcatattgaagtggtcgggtatttgattttaggggtggtcctgggtgggtgcatagcggtgctatatcaccttccttgctgggtcgaaatcagggtctttatctgctgggtcagacattgtggggaggaaccatga

SEQ ID NO: 985 - DNA, 321 bp, Adenovirus D13
  MISC_FEATURE (1)..(321): D13.orf00026 E3 12.2 kDa protein
atgtcctatggtgactcggctgagctcgctcggttgaggcatctggaccactgccgccgcctgcgctgcttcgcccgggagagctgcggcctcatctactttgagctgcccgaggagcaccccaacggccctgcacacggagtgcggatcaccgtagagggcaccaccgagtctcacctggtcaggttcttcagccagcaacccttcctggtcgagcgggaccggggcgccaccacctacaccgtctactgcatctgtcctaccccgaagttgcatgagaatttttgctgtactctttgtggtgagtttaataaaagctaa

SEQ ID NO: 986 - DNA, 684 bp, Adenovirus D13
  MISC_FEATURE (1)..(684): D13.orf00027 L4 pVIII
atgagcaaggagattcccacaccttacatgtggagctatcagccccagatgggcctggccgcgggcgcctcccaagactactccacccgcatgaactggctcagtgccgggccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaaatagccggagccgggagatcctccttcactcccaaccaggcctacctgaccttgcagagcagctcttcggagcctcgctccggaggcatcggaaccctccagttcgtggaggagtttgtgccctcggtctacttcaaccccttctcgggctcgccaggcctctacccggacgagttcatcccgaacttcgacgcagtaagagaagcggtggacggctacgactga

SEQ ID NO: 987 - DNA, 186 bp, Adenovirus D13
  MISC_FEATURE (1)..(186): D13.orf00029 L4 22 kDa protein
gtgaagggtgacggtaagcacgagcggcagggctaccgatcatggagagcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaa

SEQ ID NO: 988 - DNA, 2193 bp, Adenovirus D13
  MISC_FEATURE (1)..(2193): D13.orf00031 L4 100 kDa protein
atggagccgcgtaagcaggagcaggaggaggacttaaccacccacgagcaacccaaaatcgagcaggacctgggcttggaagagccggctcgtctagaacccccacaggatgaacaggagcacgagcaagacgcaggccaggaggagaccgacgctgggctcgagcatggctacctgggaggaggagatgtgctgctgaaacacttgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctaccccgtcttcgcggtccccgaggccctcgtcacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaatgccaggctggccgtgctcaagcgcagcgtcgagctcacccatttcgcctaccccgccgtcaacctcccgcccaaggtcatgcgtcgcatcatggatcagctcatcatgccccacatcgaggccctcgatgaaagtcaggagcagcgccccgaggacgcccaaccggtggtcagcgacgagcagctcgcgcgctggctcgggacccgcgacccccaggccctggagcagcggcgcaagctcatgctggccgtggtcctggtcaccctcgagctggaatgcatgcgccgcttctttagcgaccccgagaccctgcgcaaggtcgaggagaccctgcactacactttcagacacggtttcgtcaggcaggcctgcaagatctccaacgtggagctgaccaacctggtctcctgcctggggatcctgcacgagaaccgcctggggcagaccgtgctccactcgaccctgaagggcgaggcgcggagggactacgtccgcgactgcgtctttctctttctctgccacacctggcaagcggccatgggcgtgtggcagcagtgtctcgaggacgagaacctgaaggagctggacaagcttcttgctagaaacctcaaaaagctgtggacgggcttcgacgagcggaccaccgctgccgacctggccgagatcgttttccccgagcgcctgaggcagacgctgaaaggcggcctgcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaggactaccacgcccacgagataaagttcttcgaggaccaatcgcgcccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagccgctagtggaggaggagatggaagaagaatgggacagccaggcagaggaggaagaatgggaggaggagagtacagaggaggaagaattggaagaggtggaagaggagcaggcaacagagcagcccgtcgccgcaccatccgcgccggcagccccggcggtcacggatacaacctccgcagcgcctccggtcaagcctcctcgtag

SEQ ID NO: 989 - DNA, 1479 bp, Adenovirus D13
  MISC_FEATURE (1)..(1479): D13.orf00033 E2A DNA-binding protein
atggccggcggcagtcaggacgtgcgccggttcatggaccgagaggccactccgccccggggccacgggtcggcgcgctatccgccggagcaggagaggagcccctcgccgccacctcctctgcccaccaagcgccgaaagtaccagcgggtgggctccgggtcttccgaggaggacgtggtccccgtagacagccctccaaaactgccaaagaagcaagccaggaagaccaaacatgtgaccaaggtagaccccgacgaagagatgccccaggaagaagatgccgtgatcgtgggagtgggattcagccagccgccggttctgttgaaggaaggcaaggacggaaaacgcatcgtggagcccgcgacccccggtgtcctgaacgtgcgcaaccccctgagtctgcctctggtctcgtcctgggagaagggcatggatgccatgaacgtgctgatggaacgctaccgcgtcgacagcggcctgcgcgatgctttcaagctcatgcccgagcagaccgagatcttccagaagatgtgccagacctggatgaacgaggaggcccgcgggctgcaactgaccttcaccacccagaagagctttagcaccgtcatgggccgcctgttgcaaggttacatcttcagccacagcgggatcgcgcacaagaactgggagtgcaccggcagcgccttgtgggaccacggctgcaccgaggtggaaggccagctcaaatgtctgcacgggacggtaatgatccacaaggaccacgtggtggaaatggatgtgaccagcgagaacggacagcgcgcgttgaaggaacagcccagcaaggccaaggtgacccagaaccgctgggggagaagcgtggttcaactgaccagccatgacgcgcgctgctgcgtgcaggatgccggatgtgggaataaccagttcagcgggaagagctgcggcctgttcttcagcgagggggccaaggcccagcaagctttcaagcagatcatggccttcgtcaaggccctctacccgaatatgcagcgcggtgcggggatgatgctgatgcccgtgcactgcgagtgtaaccacaagccccacagcgtgcccttcctgggccgccagctgtgcaagatgaccccgttcggcctgagcaacgccgaggacctggacaaggatcagatcagcgacaagagcgtgctggccagcgtgaagtaccccagtctgatggtgttccagtgctgcaaccccgtgtaccgcaactcgcgcgcgcagagtaccggccccaactgcgatttcaagatctcagccccggacatgctgggcgccctgcagatgagccggcgcatgtggagcgagaccttccccgagattcccgttcccaaactggtgatccccgagttcaagtggcagcccaagtaccagtaccgcaacgtagccctccccagcgcggcgcacaacgatgagcgcgagaaccccttcgacttttaa

SEQ ID NO: 990 - DNA, 624 bp, Adenovirus D13
  MISC_FEATURE (1)..(624): D13.orf00034 L3 protease
atgagcggctccagcgaacgagagctcgcggccatcgtgcgcgacctgggctgcgggccctactttttgggcacccacgacaagcgcttcccgggcttcctcgccggcgacaagctggcctgcgccatcgtcaacacggccggccgcgagacaggaggcgtgcactggctcgcctttggctggaacccgcgctcgcgcacctgctacatgttcgacccctttgggttctcggaccgccggctcaagcagatttacagcttcgagtacgaggccatgctgcgccgcagcgccctggcttcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggagctctaccgcttcctcgcgcgccactccccttactttcgatcccaccgcgccgccatcgaacacgccaccgcttttgacaaaatgaaacaactgcgtgtatga

SEQ ID NO: 991 - DNA, 2820 bp, Adenovirus D13; identical to SEQ ID NO: 209
  MISC_FEATURE (1)..(2820): D13.orf00038 L3 hexon

SEQ ID NO: 992 - DNA, 711 bp, Adenovirus D13
  MISC_FEATURE (1)..(711): D13.orf00039 L3 pVI
atggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgtctggacccgcgcccgcccgccgccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacctacgcccgctccaccgaaagcagctccggttgtgcagccccctccggtggcgaccgccgtgcgccgcgtccccgcccgccgccaggcccagaactggcagagcacgctgcacagtatcgtgggcctgggagtgaaaagtctgaagcgccgccgatgctattga

SEQ ID NO: 993 - DNA, 225 bp, Adenovirus D13
  MISC_FEATURE (1)..(225): D13.orf00041 L2 pX core protein L2 pX
atggctctcacttgccgcctgcgcatccccgtcccgaattaccgaggaagatcccgccgcaggagaggcatgacaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttga

SEQ ID NO: 994 - DNA, 1005 bp, Adenovirus D13
  MISC_FEATURE (1)..(1005): D13.orf00044 L2 pV
atgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggaagtgctggacagcgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcagaccgacccctggctcccagcttctaccgccaccgcctctacatctaccgccgccacggctaccgagcctcccaggaggcgaagatggggcgccgccagccggctgatgcccaactacgtgttgcatccttccatcatcccgacgccgggctaccgcggcacccggtactacgccagccgcaggcgcccagccagcaaacgccgccgccgcaccaccacccgccgccgtctggcccccgcccgcgtgcgccgcgtgaccacgcgccggggccgctcgctcgttctgcccaccgtgcgctaccaccccagcatcctttaa

SEQ ID NO: 995 - DNA, 588 bp, Adenovirus D13
  MISC_FEATURE (1)..(588): D13.orf00045 L2 pVII
atgtctattctcatctcgcccagcaataacaccggctggggtcttactaggcccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagtacgcccgccatgcgcgccgcccgggctctgctgcgccgcgccagacgcacgggccgccgggccatgatgcgagccgcgcgccgcgctgccgctgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctga

SEQ ID NO: 996 - DNA, 1554 bp, Adenovirus D13; identical to SEQ ID NO: 179
  MISC_FEATURE (1)..(1554): D13.orf00046 L2 penton

SEQ ID NO: 997 - DNA, 147 bp, Adenovirus D13
  MISC_FEATURE (1)..(147): D13.orf00048 L1 pIIIa L1 pIIIa 62.1 kDa protein
gtgcgtggggttggtccgagaggggaccaccgcctccagaatggccgagagtctgttggcctgcggctgttgtctaaaggactcggggttgcgggtcgtcagggccatgatgcgttgcatcgcggcctcccagtcgtccgatgctag

SEQ ID NO: 998 - DNA, 1515 bp, Adenovirus D13
  MISC_FEATURE (1)..(1515): D13.orf00049 L1 pIIIa
gtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgttggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccggactactttttccagacgagccggcagggcttgcagacggtgaacctgagccaggctttcaagaatctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtatagggaggccataggccaggcgcaggtggacgagcagacattccaggagatcacgagcgtgagccgcgcgctggggcagaacgacaccgacagtctgagggccaccctgaacttcttgctgaccaatagacagcagaagatcccggcgcagtacgcactgtcggccgaggaggaaaggattctgagatatgtgcagcagagcgtagggctgttcctgatgcaggagggggccacccccagcgccgcgctggacatgaccgcgcgcaacatggaacctagcatgtacgccgccaaccggccgttcatcaataagctgatggactacctgcaccgcgcggcggccatgaacacggactactttaccaacgccatcctgaacccgcactggctcccgccgcctgggttctacacgggcgagtacgacatgcccgaccccaacgacgggttcctgtgggacgacgtggacagcgcggtgttctcgcccgcctttcaaaagcgtcaggaagcggtgcgcacgcctagcgagggcgcggtgggacggagcccctttcctagcttggggagtttgcatagcctgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggtggggccaacccgttcgcgcatctgcagcccagactggggcggcggatgttttga

SEQ ID NO: 999 - DNA, 1125 bp, Adenovirus D13
  MISC_FEATURE (1)..(1125): D13.orf00051 L1 52 kDa protein
atgcatcccgtcctgcgccaaatgcgtcccacccccccggcgaccaccgcgaccgcggccgtagcaggcgccggcgctagccagccacagccacagacagaaatggacttggaagagggcgaagggctggcgagactgggggcgccgtccccggagcgacacccccgcgtgcagctgcagaaggacgtgcgcccggcgtacgtgcccgcgcagaacctgttcagggaccgcagcggggaggagcccgaggagatgcgcgactgccggtttcgggcgggcagggagctgcgcgatggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggccctgggtctgatgcacctgtgggacctggcggaggccatcgtgcagaacccggacagcaagcctctgacggcgcagctgttcctggtggtgcagcacagcagggacaatgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccttacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagcctgcgccgggcgctggtaggaggcgccaccggcggcgaggagtcctacttcgacatgggggcggacctgcattggcagccgagccggcgcgccttggaggccgcctacggtccagaggacttggatgaggatgaggaagaggaggaggatgcacccgttgcggggtactga

SEQ ID NO: 1000 - DNA, 1851 bp, Adenovirus D13
  MISC_FEATURE (1)..(1851): D13.orf00053 pTP
atggactatttcctgccgctgcgcaacatctggaaccgcgtccgcgagttcccgcgcgcctccaccaccgccgccggcatcacctggatgtcccgctacctctacggctaccaccgcctcatgctcgaggacctggccccgggcgcgccggccacccagcgctggccgctctaccgccagccgccgccgcacttcctagtgggctaccagtacctcgtgcgcacctgcaacgactacgtcttcgactcgcgcgccttctcgcggctcaggtactccgaggtcgtgcagcccggcctgcagaccgtcaactggtcgctcatggccaactgcacctacaccatcaacaccggggcctaccaccgcttcgtcgacatggacgacttccaggacaccctcacccgcgtgcaacaggccatcctcgccgagcgcgtcgtcgccgacctggcgctcgtgcagccgctcaggggcgtcggggtcacccgcatggaagactccgcctccgccagtgatgacatcgagaggctcatgcatgactactacaagaacctgagccggtgtcagggccaggcctggggcatggccgagcggctccgcatccagcaagcgggacccaaggacctggtcctcctcgccaccatccgccgcctcaaaaacgcctacttcaattacatcatcagcaaccgcaattctaacagcgtccacagggctgctacgtgtctgagcttaccttgcgactgcgattggctagacgctttcctcgaaagattctccgatccggtcgatctcgacgcgctcacgtcccctacaccgcaattgataagatgcatagtcagcgccctctcgctgcccaacggggacccgccccattaccgggagatgaccggcggcgtcttcacgctgcgtcctcgcgaacggggtcgcgccgtcaccgaaaccatgcgtcgccgccgcggggagatgatcgagcgcttcgtcgaccgtctcccggtgcgtcgccgtcgtcgtcgggccccgccaccaccgcccccagaggaagaaatagaagaggtcgtcatggaagaagaagaggaagaggaggaggcccccggggatttcgagcgcgaggtgcgcgccaccatcgccgagctcatccggctcctggaagacgagctcacggtctcggcccgcaacgcccagtttttcaacttcgccgtggacttctacgaggccatggaaaggctggaggccatcggcgacatcagcgagatgcccctgcgccgctggatcatgtacttctttgtcaccgagcacatcgccaccaccctcaactacctcttccagcgcctgcgcaactacgccgtcttcgcgcggcacgtggagctcaacttcgcgcaggtggtcatgcgcgcgcgagacgccgacggggacgtggtctacagccgcgtctggaacgagagcggcctgggcgccttctcgcagctcatgggtcgcatctccaacgacctcgccgccaccgtcgagcgcgcgggccgcggcgatctccaggaggaggagatcgagcagttcatgtccgagatcgcctaccaggacaactcgggcgacgtgcaagagatcctgcgtcaggccgccgtcaatgacgccgagattgattctgttgaactgtctttcaggttcaaagtcacggggcccgtggtcttcacgcagaggcggcagatccaggatgtcaaccgccgcgtcgtcgcgcacgccagcgctctcagggcgcagcaccgggacctgcccgagcgccacgccgacgtgcctctgccgcccctgcccgcggggccggaaccgccgctgccgccgggagcgcgtccgcgacaccgcttctaa

SEQ ID NO: 1001 - DNA, 3267 bp, Adenovirus D13
  MISC_FEATURE (1)..(3267): D13.orf00057 E2B DNA polymerase
gtggacacggccaccaactcacccgtagaaatcaagtaccatctgcatctcaagcacgccctcacccgcctctacgaggtcaacctcagaaccctgcccccggacctggatctccgcgacaccatggacagctcccaactgcgcgccctcgtcttcgctctccgcccccgccgcgccgagatctggacctggctcccgcgcgggctcgtcaacctctccgtcctcgaggagccccagggtgagtcccacgcaggcgaacatgaaaaccaccagccagggccgccactcctgaagttcctcctcaagggacgcgctgtgtatctcgtggatgaggtacagcccgtgcagcgctgcgagtactgcggacgcttttacaagcatcagcatgagtgctcggttcgccggcgggatttctactttcatcacatcaacagccactcgtccaactggtggcaggaaatccagttcttccccatcggctctcatcctcgcacggagcggctctttgtcacctacgatgtagaaacctacacctggatggggtccttcggcaagcagctcgtccccttcatgctggtcatgaaattctccggggaccccgagctggtcgccctcgctcgcgatctcgccgtgcgcttacgctgggatcgctgggagcgggaccccctcaccttctactgcgtcacccccgaaaagatggccgtgggccaacagttccgcctctttcgcgacgagctccagaccctcatggcccgcgagctctgggcttccttcatgcgtgccaacccacatctccaggagtgggcgctcgagcagcacggcctgcaatgccccgaggacctcacctacgaggagctcaaaaagctgccgcacatcaaaggccgcccgcgattcatggaactttacatcgtcgggcacaacatcaacggcttcgacgagatcgtcctcgccgcccaggtcatcaacaaccgagcctccgtcccgggccctttccgcatcacccgcaatttcatgccgcgggcaggcaagattctcttcaatgacgtcactttcgctctgcctaaccccctctcgaagaagcgcaccgatttcgagctctgggagcacggcggctgcgacgactcggatttcaagtaccagttcttgaaagtcatggtcagggacaccttcgccctgacgcacacctcgctccgcaaggccgctcaagcttacgccctcccggtggagaagggctgctgtccctacaaggccgtgaaccaattctacatgctgggctcttaccgtgcggacgatcgaggattcccgctccgggagtactggaaggatgacgaggagtacgccctcaaccgcgagctgtgggagaagaaaggagagccgggttatgacatcatccgcgaaacgctcgactactgcgccatggacgtcctcgtcaccgccgagctcgtcgccaagctgcaagactcctacgcgcacttcatccgcgactcggtccgcctgcctcacgcccactttaacatcttccaaaggcccaccatctcttccaactcgcatgccatctttcgccagatcgtcttccgcgccgagcagccgcaacgcaccaatctcggccccgcctttttggcaccctcgcacgagttgtatgactatgtgcgcgccagcatccgcggggggcgctgttatcccacctacatcggcatcctctcggagcccatctatgtctatgacatctgcggcatgtacgcctccgcgctcacgcatcccatgccctggggtccgcccctcaatccctacgagcgagcgctggccgcccgcgagtggcagatggccttggatgatgcatcctcaaaaatcgattattttgacaaggaactctgtccgggcatcttcactatcgatgcggacccccctgacgagcatctgcttgatgtgttgccccctttctgctcgcgcaagggcgggcgcctctgctggacgaatgagcccctgcgcggcgaggtggccaccagcgtggacctggtcaccctgcataaccgcggctggcgcgtcaggatcgtgccagacgagcgcaccaccgtcttccccgaatggaagtgcgtagcgcgcgagtatgtccagctcaacatcgcggccaaggagcgcgccgaccgtgacaaaaatcagaccatgagatccatcgccaagctactttcaaacgccctctatggctccttcgccaccaagcttgacaataaaaaaatagtcttttctgaccagatgaatgaaagtctcctgaaaagcatcgcggcagggcaagctaacatcaaatcctcctcgtttctagaaactgacaacctgagtgccgaggtcatgcccgctctcgagagggaatacttaccccaacagctggcgctcgtggacagcgacgcggaagagagtgaggacgagcacagacccgcccccttttatacccccccgtcggggacccccggtcacgtggcctacacctacaagccaatcaccttcttggatgcggaggagggggacatgtgcctgcacacggtggaaaaggtggaccccctggtggacaacgaccgctacccctcgcacgtggcctcctttgtcttggcgtggacgcgcgccttcgtctcagagtggtccgagtttctctacgaggaggaccgcgggacgcccctgcaggacaggcccatcaagtccgtctacggggacaccgacagcctgtttgtcaccgagcgcggacacagactcatggagacgcgaggtaagaagcgcatcaaaaagaacgggggaaaactggtttttgaccccgagcagcccgagctcacctggctcgtggagtgcgagaccgtctgcgcccactgtggagcggacgcctttgcccccgagtccgtctttctcgcgcccaagctctacgccttgcaatccctcctctgtcccgcctgcgggcgctcttccaaaggcaagctccgcgccaagggccacgccgccgaggccctcaactacgagctcatggtcaactgctatctcgccgacgcgcagggcgaagaccgtgcccgtttcagcaccagcaggatgagtctcaagcgcacccttgcaagcgcccagcccggggcccaccccttcaccgtgacggagaccacgctcacgcggaccctgagaccctggaaggacatgacgctggcagcgctggacgcccatcgtctcgtgccttacagtcgcagtcgtcccaacccccgaaacgaggaagtctgctggatcgagatgccgtag

SEQ ID NO: 1002 - DNA, 1041 bp, Adenovirus D13
  MISC_FEATURE (1)..(1041): D13.orf00058 pIVa2 IVa2
atggccgacgggctcaagcccctgaaaaactttgcttccctgcaagagctcctctcgctgggcggggaccgcctcctcggcgagctcgtccgggaaaacctccaagtcagggacatgcttaacgaggtggcccccctcctccgggacgacggcagctgcatctccttgaactaccacctgcaacccgtcatcggggtcatctacggcccgaccgggtgcggcaagtcccagctgttgagaaacctgctctcctcgcagctcatcacccccgccccggaaaccgtttttttcatcgccccgcaggtggacatgattcccccctccgagatgaaagcctgggagatgcagatatgcgaggggaatttcgccccggggcccgagggaaccattgtcccccaatctggcaccctccgccccaaattcattaaaatgtcttatgatgatctcacccaggagcataattacgatgtctctgatcccaggaacgtctttgccaaagccgcagcccacgggcccattgccatcatcatggatgagtgcatggaaaacctgggcgggcacaagggcgtctccaaattcttccacgcattcccttccaagttgcatgacaaattccccaagtgcacgggctacaccgtcctggtggtcctgcacaacatgaacccccggcgggatctgggcggcaatatcgccaacctcaagatccaggccaaactgcacatcatctccccccgcatgcatccctcccagctcaaccgcttcgccaacacctacaccaaggggctccccgtggccatcagtctcctcctcaaggacatcatccagcaccacgcccagcgcccctgctatgactggatcatctacaacacgaccccagagcacgaggccatgcagtggtgctacctccatccccgggacgggctcatgcccatgtacctcaacatccaatcccacctctaccgggtcttggaaaaaatccaccgcactctcaatgatcgggagaggtggaccagggcctatcgcgcgcgaaaaaataaataa

SEQ ID NO: 1003 - DNA, 408 bp, Adenovirus D13
  MISC_FEATURE (1)..(408): D13.orf00061 pIX protein
atgaacgggaccggcggggccttcgaaggggggcttttcagcccttatttgacaacccgcctgccgggatgggccggagttcgtcagaatgtgatgggatcgacggtggatgggcgcccagtgcttccagcaaattcctcgaccatgacctacgcgaccgtggggacgagctcgtcgctcgacagcaccgccgcagccgcggcagccgcagccgccatgacagcgacgagactggcctcgagctacatgcccagcagcggtagcagcccctccgtccccagttccatcatcgccgaggagaaactgctggccctgctggccgagctggaagccctgagccgccagctggccgccctgacccagcaggtgtccgagctccgcgagcaacagcagcagcaaaataaatga

SEQ ID NO: 1004 - DNA, 1497 bp, Adenovirus D13
  MISC_FEATURE (1)..(1497): D13.orf00062 E1B 55 kDa protein
atggagccaggacacccaactgagcaggggctacatcctggacttcgcagccatgcacctgtggagggcctggatcaggcagcggggacagagaatcttgaactactggcttctacagccagcagctccgggtcttcttcatctacacagacaaacatccatgttggaggaagaaatgagggaggccatggacgagaacccgaggagcggcctggaccctccgtcggaagaggagctggattgaatcaggtatccagcctatacccagagcttagcagggtcctgaccaacggatccataggtgcgaggggagtgaagagggagaggagcgatggtggcaataccgggatgatgaccgagctgactgccagcctgatgaatcgcaagcgcccagagtgcattacctggcatgagctacagatggagtgcagggatgaggtgggcctgatgcaggataaatatggcctggagcagataaaaactcactggttgaacccagatgaggattgggaggaggccattaagaagtatgctaagatagccctgcgcccagattgcaagtacaggatcactaagacggtgaatatcagacatgcctgctacatctcagggaatggggcagaggtggtcatcgataccctggacaagtctgccttcaggtgttgcatgatgggaatgagagccggtgtgatgaatatgaattccatgatcttcatgaacatgaagtttaatggagagaagtttaacggggtgctgttcatggccaacagccatatgaccctgcatggctgcaagttcttcggattcaacaatatgtgtgcagaggtgtggggctcagccaagatcaggggctgtgtgtattatggttgctggatgggcgtggtcggaagacccaagagcgagatgtctgtaaagcagtgtgtgtttgagaagtgctacctgggagtctctaccgagggcaatgctcgggtgagacactgttcttccatcgagacgggctgcttctgcctggtgaagggcacagcctcgctcaagcataatgtgatcaaggggtgcacggatgagcgcatgtacaacatgctgacctgcgactcgggtgtctgccatatcctgaagaacatccatatcacctcccacgctagaaagaagtggccagtgtttgagaataacatgctgatcaagtgccatgtgcacctgggtgtcagaaggggcaccttccagccgtaccagtgcaactttagccagaccaagctgctgctggagagcgatgccttctccagggtgaacctgaacggcatctttgacatggatgtctcggtgtacaagatcctgagatacgatgagaccaggtccagggtgcgcgcttgcgagtgcggaggcagacacaccaggatgcaaccagtggccctggatgtgaccgaggagctgaggcccgaccacctggtgatggcctgtaccgggaccgagttcagctccagcggggaggacacagattag

SEQ ID NO: 1005 - DNA, 249 bp, Adenovirus D13
  MISC_FEATURE (1)..(249): D13.orf00065 E1B 19 kDa protein
atgactcatgggcggggcttagtcctatataagtggcaacacctgggcactcaggcacagaccttcagggagttcctgatggatgtgtggactatccttgcggactttaacaagacacgccggcttgtagaggatagttcagacgggtgctccggtttctggagacactggtttggaactcctctatctcgcctggtgtacacagtaaagaaggattatcaggaggaatttgaaaatcttttttgctga

SEQ ID NO: 1006 - DNA, 207 bp, Adenovirus D13
  MISC_FEATURE (1)..(207): D13.orf00066 E1A 14.8 kDa protein
gtgtcagaggatgagtcatcgccctcagaagaagaccacccgtctccccctgagctgtcaggcgaaacgcccctgcaagtgcacagacccaccccagtcagacccagtggcgagaggcgagcagctgttgaaaaaattgaggacttgttgcatgacatgggtggggatgaacctttggacctgagcttgaaacgccccaggaactag

SEQ ID NO: 1007 - DNA, 558 bp, Adenovirus D13
  MISC_FEATURE (1)..(558): D13.orf00068 E1A 28 kDa protein
atgagacacctgcgccttctaccttcaactgtgcccggcgacctggctgtgataatgctggaggactttgtgaatacagttctggaggacgaactgcatccaacaccgttcgagctgggacccacacttcaggatctctatgatctggaggtagatgcccatgatgacgaccctaatgaagaggctgtgaatttaatatttccagaatctatgattctccaggctgacatagccagcgaagctgtagttactccacttcataccccgactctgccaccaatacctgaattggaagaggaggacgagctagaccttcggtgttatgaggaaggttttcctcccagcgattcagaggacgaacagggtgagcagagcatggctctaatctcagactatgcttgtgtgattgtggaggagcaagatgtgattgaaaaatctactgagccagtacaaggctgtaggaactgcaagtaccaccgggataagtccggagatccaaaagcctcatgtgctctgtgctatatgaaacagactttcagctttatttacagtaagtag

SEQ ID NO: 1008 - DNA, 378 bp, Adenovirus D17
  MISC_FEATURE (1)..(378): D17.orf00002 E4 14.0 kDa protein
atggctgaatctctgtatgctttcatagatagtcctggagggattgctcccgtccaggaaggggctagcaatagatataattttttttgccctgaatctttccacattcctccgcatggggtggtattgcttcacctaaaagtgagtgtgctggttcctactggatatcagggcagatttatggccttgaatgactaccatgccagggacatactaacccagtccgatgtgatttttgccggaagaagacaggaacttactgtgctgctttttaatcacacggaccgatttttgtatgtccgcaagggccacccagtgggtaccctgctgctggaaagagtgatttttccttcagtgaaaatagccaccttagtttag

SEQ ID NO: 1009 - DNA, 309 bp, Adenovirus D17
  MISC_FEATURE (1)..(309): D17.orf00003 E4 14.5 K E4 ORF2 14.5 kDa protein
atgattaaagaaaaactaccacgctttatcactcacattttggaaggcatcaccggagacacaaagagagcttattccagcatgcagtttttgggtgctagctttggagcattaaagttttccctcacgcttgccagtcccacgcttagccctggctctgaattgtcagctgtagtggcccaggacttaagtgactttttgcagctgacattgaggcgcgagctcagggcggagggcagaaccttattgaatcttgttgttttgaacacgctgcaggtggtggagcagcaggatctgtttctattatga

SEQ ID NO: 1010 - DNA, 354 bp, Adenovirus D17
  MISC_FEATURE (1)..(354): D17.orf00004 E4 13.5 kDa protein
atgaaggtctgcctgattatgaaagtggagggggcactgtgggagcttttcaacatgtgcggagtggatttacaccaacaatttgtagagataatccaaggctggaaaaatgagaattacctggggatggtgcaggaatgtaacctgatgattgatgaaatcgatggagggccagcctttaatgtgattcttatgctggatgtacgcgtagagccactgctcgaagccacggtcgagcaccttgaaaatagagtgggttttgacctggctgtctgtttccaccagcacagcggaggggaacgctgtcacctgcgtgacttgcactttatcgtccttcgagaccgtttggaataa

SEQ ID NO: 1011 - DNA, 879 bp, Adenovirus D17
  MISC_FEATURE (1)..(879): D17.orf00007 E4 34.1 kDa protein
atgcaaaccgagattcaatccagctcgctccgccatcatccatatcgcagggcccgtttaccacgatctgatgatgaaaccagggcttcactgactgatcaacatcccctgttgcccgattgtgatcatgcagattatcataatgtaagttctgtccgtggattaccatgtgctgctggctttaccctgctccaagagtttccagtcccctgggatatgatcctcaccacagaggaaataaaaattttaaaaagatgtatgtcagtgtgcctgtgccccgctaccctggacttggtaagagctcagatggtgagcgggtacgagcgctggatcctgcattgccactgttcatcccctggctccctgcagtgtcgggcgggaggcaccctgctggccgtgtggttcaggagagtcatttacgggtgcatgttcaaccagcgcttcccctggtaccgccagattgtaaacagaaacatgcccaaagagatcatgtatatgggcagtgtgttcatgaggggcaggcacctgatatactgccgcatctggtacgatggtcacgtgggttccatcatccccaacatgagctttggctggagcaccctgaattatgggctgctgaataacatggtgattatgtgctgcacttactgtgagaacatggcagagatcaggatgcggtgctgtgctcgacgcaccaggagactgatgctgaaggctgttgggatcatagttagagagacttgtgatcccgatcccatctgcagcagccgcaccgagccccggcggcagagactgctgagggcgctgatggagaggcacagacccatcctgttttccgagtatgaatctgtgcgttcttctcgttccaccagactgtga

SEQ ID NO: 1012 - DNA, 246 bp, Adenovirus D17
  MISC_FEATURE (1)..(246): D17.orf00009 E4 ORF6/7 protein
gtgaccttggactgtgaggcccgcttggatgacttttcagaggacggcttcatttcaatcaccgatccccgtttggctcgccaggaaactgtgtggattatagaccccaagtccagttcccgcactaatcagaacatttccctatttaaggccacccgtgctgagagaaccgtgtacactgtgaaatgggctggtggtgggagattgactactcgcgctggtgtaaaaatcaataaagatacataa

SEQ ID NO: 1013 - DNA, 1101 bp, Adenovirus D17; identical to SEQ ID NO: 150
  MISC_FEATURE (1)..(1101): D17.orf00011 L5 fiber

SEQ ID NO: 1014 - DNA, 150 bp, Adenovirus D17
  MISC_FEATURE (1)..(150): D17.orf00012 U protein
atgaaaattgtggaccaggaatttgacatccctttcaaggtgtggagaaagttcgccgcccgccggagactggagtaccagagttgggaggagggtaccgaggtgctgctgaacaactacaccagagacatactttcagatttcaagtaa

SEQ ID NO: 1015 - DNA, 393 bp, Adenovirus D17
  MISC_FEATURE (1)..(393): D17.orf00014 E3 14.8kDa protein
atgactgaccaccacctggacctcgagatggacggccaggcctccgagcagcgcatcctgcaactgcgcgtccgtcagcagcaggagcgtgccgccaaggagctcctcgatgccatcaacatccaccagtgcaagaagggcatcttctgcctggtcaaacaggcaaagatcacctacgagctcgtgtccaacggcaaacagcatcgcctcacctatgagatgccccagcagaagcagaagttcacctgcatggtgggcgtcaaccccatagtcatcacccagcagtcgggcgagaccaacggctgcatccactgctcctgcgaaagccccgagtgtatctactcccttctcaagaccctttgcggactccgcgacctcctccccatgaactga

SEQ ID NO: 1016 - DNA, 276 bp, Adenovirus D17
  MISC_FEATURE (1)..(276): D17.orf00017 E3 RID-alpha
atgattcctaggttcttcctatttaacatcctcttctgtctcttcaacatctgtgctgcctttgcggcagtttcgcacgcctcgcccgactgtctagggcctttccccacctacctcctctttgccctgctcacctgcacctgcgtctgcagcattgtctgcctggtcatcaccttcctgcagctcatcgactggtgctgcgcgcgctacaattaccttcatcatagtcccgaatacagggacgagaacgtagccagaattttaaggctcatatga

SEQ ID NO: 1017 - DNA, 813 bp, Adenovirus D17
  MISC_FEATURE (1)..(813): D17.orf00019 E3 34.1 kDa protein
atgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatttgtgaatggaatgttactgcatacaaatgcttcaataatggaagcattactattactgccactgccaacattacttctggcacatacaaagctgaaagctataaaaatgaaattaaaaaattaacctataaaaacaacaaaaccacatttgaagattctggaaattatgagcatcaaaaattatctttttatatgttgacaataattgaactgcctacaaccaaggcacccaccacagttagtacaactacacagtcaactgttaagaccactactcacactacacagctagacaccacagtgcagaataatactgtgttggttaggtatttgttgagggaggaaagtactactgaacagacagaggctacctcaagtgcctttatcagcactgcaaatttaacttcgcttgcttggactaatgaaaccggagtatcattgatgcatggccagccttactcaggtttggatattcaaattacttttctggttgtctgtgggatctttattcttgtggttcttctgtactttgtctgctgtaaagccagaaagaaatctaggaggcccatctacaggccagtgattggggaacctcagccactccaagtggatggaggcttaaggaatcttcttttctcttttacagtatggtga

SEQ ID NO: 1018 - DNA, 1263 bp, Adenovirus D17
  MISC_FEATURE (1)..(1263): D17.orf00020 E3 47.7 kDa protein
atgaatacagtgatccgtatcgtgctgctctctcttcttgtaacttttagtcaggcaggatttcataccatcaatgctacatggtgggctaatataactttagtgggaccctcagatattccagtcacatggtatgatagcactggattgcaattttgtgatggaagtacagttaagaatccacagatcagacatagttgtaatgatcaaaacttaactctgattcatgtgaacaaaacccatgaaagaacatacatgggctataataagcagagtactcataaagaagactataaagtcacagttataccacctcctcctgttactgtaaagccacaaccagagccagaatatgtgtatgttaatatgggagagaacaaaaccttagttgggcctccaggaattccagttagttggtttaatcaggatggtttacaattttgcattggggataaagtttttcatccagaattcaaccacacctgtgacatgcaaaatcttacactgttgtttataaatcttacacatgatggagcttatcttggttataatcgccagggaactgaaagaacttggtatgaggttgtagtgtcagatggttttccaaaatcagaagagatgaaggtagaagaccatagtaaagaaacagaacaaaaacagactggtcaaaaacaaagtgaccataagcagggtgggcaaaaagaaacaagtcaaaagaaaactaatgacaaacaaaagccatcgcgcaggaggccatctaaactaaagccaaacacacctgacacaaaactaattacagtcactagtgggtcaaacgtaactttagttggtccagatggaaaggtcacttggtatgatgatgatttaaaaagaccatgtgagcctgggtataagttagggtgtaagtgtgacaatcaaaacctaaccctaatcaatgtaactaaactttatgagggagtttactatggtactaatgacagaggcaacagcaaaagatacagagtaaaagtaaacactactaattctcaaagtgtgaaaattcagccgtacaccaggcctactactcctgatcagaaacacagatttgaattgcaaattgattctaatcaagacaaaattccatcaactactgtggcaatcgtggtgggagtgatcgcgggctttgtaactctaatcattattttcatatgctacatctgctgccgcaagcgtcccaggtcatacaatcatatggtagacccactactcagcttctcttactga

SEQ ID NO: 1019 - DNA, 306 bp, Adenovirus D17
  MISC_FEATURE (1)..(306): D17.orf00021 E3 17.5 kDa protein
atgggaaatgcatgggtgggcgactgggaaccaggagatgagcagaactacacggtcactgtccatggtagcaatggaaatcacacttttggtttcaaattcatttttgaagtcatgtgtgatatcacactgcatgtggctagacttcatggcttgtggccccctaccaaggataacatggttgggttttctttggcttttgtgatcatggcctgtgcaatgtcaggtctgctggtaggggctttagtgtggttcctaaagcgcaagcctaggtatggaaatgaggagaaggaaaaattgctataa

SEQ ID NO: 1020 - DNA, 573 bp, Adenovirus D17
  MISC_FEATURE (1)..(573): D17.orf00022 E3 22.2 kDa protein
gtgctgagtttaataaaagctaaactcctacaatactctgggatcccgtgtcgtcgcactcgcaacaagaccttcaacctcaccaaccagactgaggtaaaattcaactgcagaccgggggacaaatacatcctctggctttttaaaaacacttccttcgcagtctccaacgcctgcgccaacgacggtattgaaatacccaacaaccttaccagtggactaacttatactaccagaaagactaagctagtactctacaatccttttgtagagggaacctaccactgccagagcggaccttgcttccacactttcactttggtgaacgttaccgacagcagcacagccgctacagaaacatctaaccttctttttgatactaacactcctaaaaccggaggtgagctctgggttccctctctaacagaggggggtaaacatattgaagcggttgggtatttgattttaggggtggtcctgggtgggtgcatagcggtgctgtattaccttccttgctggatcgaaatcaaaatctttatctgctgggtcagacattgttgggaggaaccatga

SEQ ID NO: 1021 - DNA, 321 bp, Adenovirus D17
  MISC_FEATURE (1)..(321): D17.orf00023 E3 12.2 kDa protein
atgtcttatggtgactcggctgagctcgctcggttgaggcacctagaccactgccgccgcctgcgctgcttcgcccgggagagctgcggacttatctactttgagtttcccgaggagcaccccaacggccctgcacacggagtgcggatcaccgtagagggcaccaccgagtctcacctggttaggttcttcacccagcaacccttcctggtcgagcgggaccggggaggcaccacctacaccgtctactgcatctgtccaaccccgaagttgcatgagaatttttgttgtactctgtgtgctgagtttaataaaagctaa

SEQ ID NO: 1022 - DNA, 684 bp, Adenovirus D17
  MISC_FEATURE (1)..(684): D17.orf00024 L4 pVIII
atgagcaaggagattcccaccccttacatgtggagctatcagccccagatgggcctggccgcgggcgcctcccaggactactccacccgcatgaactggctcagtgccggcccctcgatgatctcacgggtcaacggggtccgtaaccatcgaaaccagatattgttggagcaggcggcggtcacctcaacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatacgaggcagaggcacacagctcaacgacgagttggtgagctcttcaatcggtctgcgaccggacggagtgttccaactagccggagccgggagatcgtccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactga

SEQ ID NO: 1023 - DNA, 219 bp, Adenovirus D17
  MISC_FEATURE (1)..(219): D17.orf00025 L4 20 kDa protein
ttgaccaccagggagctgaggaatcggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaa

SEQ ID NO: 1024 - DNA, 141 bp, Adenovirus D17
  MISC_FEATURE (1)..(141): D17.orf00026 L4 encapsidation protein
gtgaaggtgacggtagtaatgcaacacgttgcgggggatgttcaccccgcgatggaagagcagatagcggcgggcgaaagcgatgttccccccgcagtcttgcaagcaggcgatgatcgcggctttgtgggccctccatga

SEQ ID NO: 1025 - DNA, 2199 bp, Adenovirus D17
  MISC_FEATURE (1)..(2199): D17.orf00028 L4 82.2 kDa protein
atggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggcccttgccacctatcacatctttttcaagaaccaaaagatccccgtctcctgccgcgccaaccgcacccgcgccgacgcgctcctcgctctggggcccggcgcgcgcatacctgatattgcttccctggaagaggtgcccaaaatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgttgagctcacccacttcgcctaccccgccgtcaacctcccgcccaaggtcatgcgtcgcatcatggatcagctaatcatgccccacatcgaggccctcgatgaaagtcaggagcagcgccccgaggacacccggcccgtggtcagcgatgagcagcttgcgcgctggcttggtacccgcgacccccaggccctggagcagcggcgcaagctcatgctggccgtggtcctggtcaccctcgagctcgaatgcatgcgacgctttttcagcgaccccgagaccctgcgcaaggtcgaggagaccctgcactacacttttaggcacggtttcgtcaggcaggcatgcaagatctccaacgtggagctgaccaacctggtctcctgcctgggaatcctgcacgagaaccgcctggggcagacagtgctccactcgaccctgaagggcgaggcgcggcgggactatgtccgcgactgcgtctttctctttctctgccacacatggcaagctgccatgggcgtgtggcagcagtgtctcgaggacgagaacctgaaggagctggacaagcttcttgctagaaacctcaaaaagctgtggacgggctttgacgagcgcaccgtcgcctcggacctggccgagatcgtcctccccgagcgcctgaggcagacgctgaaaggcgggctgcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacatcgcctaccactcggatgttatcgaggacgtgagcggcgaggggctgctagagtgccactgccgctgcaacctgtgctctccgcaccgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgcccgcagcacgcggatctcacggcctgcgtcatcacccagggcgcgatcctcgcccaattgcacgccatccaaaaatcccgccaagagtttcttttgaaaaagggtagaggggtctatctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgcagctccggccaagcctcctcgtag

SEQ ID NO: 1026 - DNA, 1473 bp, Adenovirus D17
  MISC_FEATURE (1)..(1473): D17.orf00029 E2A DNA binding protein
atggccggcggcagtcaggacgtgcgccggttcatggagcgagaggccactccgccccggggccacgggtcggcgcgctatccgccggagcaggagaggagcccctcgccgccgccacctcctctgcccaccaagcgccgaaagtatcagcgggtgggctccgggtcttccgaggaggacgtggtccccgtggacagccctccaaaaaagaagcaagccagaaagaccaagcatgtgaccaaggtagaccccgacgaagagatgccccaggaagatgccgtgattgtgggagtgggattcagccagcctccggttctgttgaaggaaggcaaggacggaaaacgtatcgtcgagcccgcgacccccggtgtcctgaacgtgcgcaaccccctgagtctgcctctggtctcgtcctgggaaaagggcatggataccatgaacgtgctgatggaacgttaccgcgtcgacagcggcctgcgcgatgcttacaagctcatgcccgagcagaccgagatcttccaaaagatgtgccagacctggatgaacgaggaggcccgcggtctgcaactaaccttcaccacccagaagagctttagcaccatcatgggtcgcctcttgcaaggttacatcttcagccacagcgggatcgcgcacaagaactgggagtgcaccggcagtgccctgtgggatcacggctgcaccgaggtggaaggccagctcaagtgtctgcatggaacggtgatgatccacaaggaccacgtggtggagatggatgtgaccagcgagaacgggcagcgcgcgttgaaggagcaacccagcaaagccaaggtgacccagaaccgctggggaagaagcgtggtgcaactgaccagccatgacgcgcgctgctgcgtgcaggatgccgggtgcgggaataaccagttcagcgggaagagctgcggcctgtttttcagcgagggggccaaggcccaacaagctttcaagcagatcacggcctttgtcaaggccctctacccgaatatgcagcgcggcgcggggatgatgctgatgcccgtgcactgcgagtgtaaccacaagcctcagagcgtgccattcctgggtcgccaactgtgcaagatgaccccattcggcctgagcaacgccgaggatctggacaaggatcagatcagcgacaagagcgtgctggccagcgtaaagtaccccagtctgatggtgttccagtgctgcaaccccgtgtaccgcaactcgcgcgcgcagagcaccggtcccaactgcgatttcaagatatccgccccggacatgctgggcgccctgcagatgagccggcgtatgtggagcgagaccttccccgagaccccagtgcccaaactggtgatccccgagttcaagtggcagcccaagtaccagtaccgcaacgtggccctccccagcgcggcgcacaacgatgagcgcgagaaccccttcgacttttaa

SEQ ID NO: 1027 - DNA, 630 bp, Adenovirus D17
  MISC_FEATURE (1)..(630): D17.orf00031 L3 protease
atgagcggctccagcgaaagagagctcgcgtccatcgtgcgcgacctgggctgcgggccctactttttgggcacccacgacaagcgattcccgggctttcttgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgaagcgccctggcctcctcgcccgaccgctgtctcagcctcgaacagtccacccagaccgtgcaggggcccgactccgccgcctgcggacttttctgttgcatgttcttgcatgccttcgtgcactggcccgaccgacccatggacgggaaccccaccatgaacttgctgacgggggtgcccaacggcatgctacaatcgccacaggtgctgcccaccctcaggcgcaaccaggaggagctctatcgcttcctcgcgcgccactccccttactttcgctcccaccgcgccgccatcgaacacgccaccgcttttgacaaaatgaaacaactgcgtgtatctcaataa

SEQ ID NO: 1028 - DNA, 2865 bp, Adenovirus D17; identical to SEQ ID NO: 210
  MISC_FEATURE (1)..(2865): D17.orf00033 L3 hexon

SEQ ID NO: 1029 - DNA, 705 bp, Adenovirus D17
  MISC_FEATURE (1)..(705): D17.orf00034 L3 pVI
atggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacggcctggcctcgggcattaacggggtggtggacatcgcgaaccaggcagtgcagcgcgagataaacagccgtctggacccgcggccgcccacggtggtggagatggaagatgcaactcttccgccgccgaagggcgagaagcggccgcggccagatgcggaggagacgatcctgcaggtggacgagccgccctcgtacgaggaggccgtgaaggccggcatgcccaccacgcgcatcatcgcgccactggccacgggtgtaatgaaacccgccacccttgacctgcctccaccacccacgcccgctccaccgaaggcagctccggttgtgcagccccctccggtggcgaccgccgtgcgccgcgtccccgcccgccgccaggcccagaactggcagagcacgctgcacagtattgtgggcctgggagtgaaaagtctgaagcgccgccgatgctattga

SEQ ID NO: 1030 - DNA, 225 bp, Adenovirus D17
  MISC_FEATURE (1)..(225): D17.orf00035 L2 pX core protein L2 pX
atggctctcacttgccgcctgcgcatccccgttccgaattaccgaggaagatcccgccgcaggagaggcatggcaggcagcggcctgaaccgccgccggcggcgggccatgcgcaggcgcctgagtggcggctttctgcccgcgctcatccccataatcgcggcggccatcggcacgatcccgggcatagcttccgttgcgctgcaggcgtcgcagcgccgttga

SEQ ID NO: 1031 - DNA, 1008 bp, Adenovirus D17
  MISC_FEATURE (1)..(1008): D17.orf00037 L2 V
atgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcagagcgggcgggcgagtttgcctacgggaagcggtcgcgcgaagaggagctgatctcgctgccgctggacgagagcaatcccacgccgagcctgaagcccgtgaccctgcagcaggtgctgccccaggcggtgctgctgccgagccgcgggatcaagcgcgagggcgagaacatgtacccgaccatgcagatcatggtgcccaagcgccggcgcgtggaggaagtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacgacccctggctcccagcctccaccgctaccgcttccacttctaccgtcgccacggtcaccgagcctcccaggaggcgaagatggggccccgccaaccggctgatgcccaactacgtgttgcatccttccattatcccgacgccgggctaccgcggcacccggtactacgccagccgcaggcgcccagccagcaaacgccgccgccgcaccgccacccgccgccgtctgccccccgcccgcgtgcgccgcgtaaccacgcgccggggccgctcgctcgttctgcccaccgtgcgctaccaccccagcatcctttaa

SEQ ID NO: 1032 - DNA, 591 bp, Adenovirus D17
  MISC_FEATURE (1)..(591): D17.orf00038 L2 VII
atgtctattctcatctcgcccagcaataacaccggctggggtattactaggcccagcagcatgtacggaggagccaagaaacgctcccagcagcaccccgtccgcgtccgcggccacttccgcgctccctggggcgcttacaagcgcgggcggactgccaccgccgccgccgtgcgcaccaccgtcgacgacgtcatcgactcggtggtcgccgacgcgcgcaactatactcccgccccctcgaccgtggacgcggtcattgacagcgtggtggccgacgcgcgcgactatgccagacgcaagagccggcggcgacggatcgccaggcgccatcggagcacgcccgccatgcgcgccgcccgagctctgctgcgccgcgccagacgcacgggccgccgggccatgatgcgagccgcgcgccgcgccgccactgcaccccccgcaggcaggactcgcagacgagcggccgccgccgccgccgccgcggccatctctagcatgaccagacccaggcgcggaaacgtgtactgggtgcgcgactccgtcacgggcgtgcgcgtgcccgtgcgcacccgtcctcctcgtccctga

SEQ ID NO: 1033 - DNA, 1458 bp, Adenovirus D17; identical to SEQ ID NO: 180
  MISC_FEATURE (1)..(1458): D17.orf00039 L2 penton

SEQ ID NO: 1034 - DNA, 228 bp, Adenovirus D17
  MISC_FEATURE (1)..(228): D17.orf00040 L2 penton
atgctgtttctgccctccgtaggagccatataccgcggaggcacaaacggaacctccagggtcgcctgcgccatcacgctctcgtacgagggaggaggagaggaagacaccaccgcacgcctcatctctaacaaggaagagaacgcacgctatggccttggtgagttttattttgcattcaaaacatccgtcgccccagtttgggctgcagatgcgcgaacgggttga

SEQ ID NO: 1035 - DNA, 1692 bp, Adenovirus D17
  MISC_FEATURE (1)..(1692): D17.orf00041 L1 IIIa
atgcagcaagccccggaccccgccataagggcggcgctgcaaagccagccgtccggtctagcatcggacgactgggaggctgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctagtgtacaacgccctgctggagcgcgtaggccgctacaacagcacaaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggatgattacaccaactttatcagcgcgctgcggctgatggtgaccgaggtgccccagagcgaggtgtaccagtcgggcccggactactttttccaaactagcagacagggcctgcaaacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagtggcagcgtaaaccgcaactcgtacctgggtcacctgctaacgctgtaccgcgaggccataggccaggcgcaggtggacgagcagaccttccaggagatcactagcgtgagccgcgcgctggggcagaacgacaccgacagtctgagggccaccctgaacttcttgctgaccaatagacagcagaagatcccggcgcagtacgcgctgtcggccgaggaggagcgcatcctgagatatgtgcagcagagcgtagggcttttcctgatgcaggagggggccactcccagcgccgcgctggacatgaccgcgcgcaacatggaacctagcatgtacgccgccaaccggccgtttatcaataagctaatggactacctgcatcgcgcggcgtccatgaactcggactactttaccaatgccattttgaacccgcactggcttccgccgccggggttctatacgggcgagtacgacatgcccgaccccaacgacgggtttttgtgggacgacgtggacagcgcggtgttttcaccgaccttgcaaaagcgccaggaggcggtgcgcacgcccgcgagcgagggcgcggtgggtcggagcccctttcctagcttagggagtttgcatagcttgccgggctctgtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggagcctgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttga

SEQ ID NO: 1036 - DNA, 1125 bp, Adenovirus D17
  MISC_FEATURE (1)..(1125): D17.orf00042 L1 42.2 kDa protein
atgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccttccccggagcgacacccccgcgtgcagctgcagaaggacgtgcgcccggcgtacgtgcctgcgcaaaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccatgtgcgcaccctgatcgcgcgcgaggaggtggccctgggcctgatgcacctgtgggacctggcggaggccatcgtgcagaacccggacagcaagcctctgacggcgcagctgttcctggtggtacagcacagcagggacaacgaggcgttcagggaggcgctgctaaacatcgccgagcccgagggtcgctggctgctggagctgatcaacatcttgcagagcatcgtagttcaggagcgcagcctgagcttggccgagaaggtggcggcaatcaactactcggtgcttagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcgcgagccggcggcgcgagctgagcgaccgcgagctgatgctgagcctgcgccgggcgctggtagggggcgccgccggcggcgaggagtcctacttcgacatgggggcggacctgcattggcagccgagccggcgcgccttggaggccgcctacggtccagaggacttggatgaggaagaggaagaggaggaggatgcacccgctgcggggtactga

SEQ ID NO: 1037 - DNA, 1851 bp, Adenovirus D17
  MISC_FEATURE (1)..(1851): D17.orf00043 pTP
atggactatttcctgccgctgcgcaacatctggaaccgcgtccgcgagttcccgcgcgcctccaccaccgctgccggcatcacctggatgtcccgctacctctacggctaccaccgcctcatgctcgaggacctggccccgggcgcgccggccacccagcgctggccgctctaccgccagccgccgccgcacttcctagtcggataccagtaccttgtgcgcacctgcaacgactacgtcttcgactcgcgcgccttctcgcggctcaggtactccgaggtcgtgcagcccggcctgcagaccgtcaactggtcgctcatggccaactgcacttacaccatcaacacaggggcctaccaccgcttcgtcgacatggacgacttccaggacaccctcacccgcgtgcaacaggccatcctcgccgagcgcgtcgtcgccgacctggcgctcgtgcagccgctcaggggcgtcggggtcacccgcatggaagactccgcctccgccagtgatgacatcgagaggctcatgcatgactactacaagaacctaagccggtgtcagggccaggcctggggcatggccgagcggctccgcatccagcaagcgggacccaaggacctggtcctcctcgccaccatccgccgcctcaaaaacgcctacttcaattacatcattagcaaccgcaattctaacagcgtccacagggctgctacgtgtttgagcttaccttgcgactgcgattggctagacgctttcctcgaaagattctccgatccggtcgatctcgacgcgctcacgtcccctacaccgcaattgataagatgcatcgtcagcgccctctcgctgcccaacggggacccgccccattaccgggagatgaccggcggcgtcttcacgctgcgtcctcgcgaacggggtcgcgccgtcaccgaaaccatgcgtcgccgccgcggggagatgatcgagcgcttcgtcgaccgtctcccggtgcgtcgccgtcgtcgtcgggccccgccaccaccaccgcccccagaggaagaaatagaagaggttgtcatggaagaagaggaagaggacgaggcccccggggatttcgagcgcgaggtgcgcgccaccatcgccgagctcatcaggctcctggaagacgagctcacggtctcggcccgcaacgcccagtttttcaacttcgccgtggatttctacgaggccatggaaaggctggaggccatcggcgacatcagcgagatgcccctgcgccgctggatcatgtacttcttcgtcaccgagcacatcgccaccaccctcaactacctcttccagcgcctgcgcaactacgccgtcttcgcgcggcacgtggagctcaacctcgcgcaggtggtcatgcgcgcgcgcgacgccgacggggacgtggtctacagccgcgtctggaacgagagcggcctgggcgccttctcgcagctcatgggtcgcatctcgaatgacctcgccgccaccgtggagcgcgcgggtcgcggcgatctccaggaggaggagatcgagcagttcatgtccgagatcgcctaccaggacaactcgggcgacgtgcaagagatcctgcgtcaggccgccgtcaatgacgccgagattgattctgttgaactgtctttcaggttcaaagtcacggggccagtggtcttcacgcagaggcggcagatccaggatgtcaaccgccgcgtcgtcgcgcacgccagcgctctcagggcgcaacaccgggacctgcccgagcgccacgccgacgtgcctctgccgcccctgcccgcggggccggaaccgccgctgccgccgggagcgcgtccgcgacaccgcttctaa

SEQ ID NO: 1038 - DNA, 3300 bp, Adenovirus D17
  MISC_FEATURE (1)..(3300): D17.orf00046 E2B DNA polymerase
gtggccccgcgcagctacgggctcatgcaatgcgtggacacggccaccaactcacccgtagaaatcaagtaccatctgcatctcaagcacgccctcacccgcctctacgaggtcaacctcagaaccctgcccccggacctggatctccgcgacaccatggacagctcccaactgcgcgccctcgtcttcgctctccgcccccgccgcgccgagatctggacctggctcccgcgcgggctcgtcagcctctccgtcctcgaggagccccagggtgagtcccacgcaggcgaacatgaaaaccaccagccagggccgccactcctgaagttcctcctcaagggacgcgctgtgtatctcgtggatgaggtacagcccgtgcagcgctgcgagtactgcggacgcttttacaagcatcagcacgagtgctcggttcgccggcgggatttctactttcatcacatcaacagccactcgtccaactggtggcaggaaatccagttcttcccaatcggctctcatcctcgcacggagcggctctttgtcacctacgatgtagaaacctacacctggatggggtccttcggcaagcagctcgtccccttcatgctggtcatgaaattctcgggggacccagagctggtcgcccttgctcgcgatctagccgcgcgcttacgctgggatcgctgggagcgggaccccctcaccttctactgcgtcacacccgaaaagatggccgtgggccagcagttccgcctctttcgcgacgagctccagaccctcatggcccgcgagctctgggcttccttcatgcaagccaacccacatctccaggaatgggcgctcgagcagcacggcctgcaatgccccgaggacctcacctacgaggagctcaaaaagctgccgcacatcaaaggccgcccgcgattcatggaactctacatcgtcgggcacaacatcaacggcttcgacgagatcgtcctcgccgcccaggtcatcaacaaccgagcctccgtcccgggccctttccgcatcacccgcaatttcatgccgcgagcaggcaagattctcttcaatgacgtcactttcgctctgcctaaccccctctcgaagaagcgcaccgatttcgagctatgggagcacggcggctgcgacgactcggatttcaagtaccagttcttgaaagtcatggtcagggacaccttcgccctgacgcacacctcgctccgcaaggccgcacaagcttacgccctccccgtggagaagggctgctgtccctacaaggccgtgaaccatttctacatgctgggctcttaccgtgcggacgatcgaggattcccgctccgggagtactggaaggatgacgaggaatacgccctcaaccgcgagctgtgggagaagaaaggagaggcgggttatgacatcatccgcgaaacgctggactactgcgccatggacgtcctcgtcaccgccgagctcgtcgccaagctgcaagactcctacgcgcacttcatccgcgactcggtccgcttgccccacgcccactttaacatcttccaacggcccaccatctcctccaactcgcacgccatctttcgccagattgtcttccgcgccgagcagccccagcgcaccaatctcggccccgccttcttggccccctcgcacgagttgtatgactacgtgcgcgccagcatccgcggggggcgctgttatcccacctacatcggcatcctctcggagcccatctatgtctacgacatttgcggcatgtacgcctccgccctcacgcatcccatgccctggggtccgcccctcaacccctacgagcgagcaatggccgcccgcgagtggcagatggccttggatgatgcatcctcaaaaatagactattttgacaagaaactctgtcccggcatcttcaccatcgatgcggacccccctgacgagcatctgcttgatgtgctgcccccgttctgctcgcgcaagggcggcagactctgctggactaacgagcccctgcgcggcgaggtggccaccagcgtggacctggtcaccctgcataaccgcggctggcgcgtcaggatcgtgcccgacgagcgcaccaccgtctttcccgaatggaagtgtgtcgcgcgcgaatatgtccagctcaacatcgcggccaaggagcgcgccgaccgtgacaaaaatcagaccatgagatccatcgccaagcttctctccaacgccctctatggctcctttgccaccaagcttgacaataaaaaaatagtcttttctgaccagatggatgaaagtctcctaaaaagcattgcggcagggcaagccaacatcaaatcctcctcgtttctagaaactgacaacctgagtgccgaggtcatgcccgctctcgagagggaatacctaccccaacagctggcgctcgtggacagcgacgcggaagagagtgaggacgagcacagacccgcccccttttatacccccccgtcggggacccctggtcacgtggcctacacctacaagccaatcaccttcttggatgcggaggagggggacatgtgtctgcacacggtggaaaaggtggaccccctggtggacaacgaccgctacccctcgcacgtggcctcctttgtcttggcgtggacgcgcgcctttgtctcagagtggtccgagtttctctacgaggaggaccgcgggacgcccctgcaggacaggccaatcaagtccgtctacggggacaccgacagcctgtttgtcaccgagcgcggacacagactcatggagacgcgaggtaagaagcgcatcaaaaagaacgggggaaaactggtttttgaccccgagcagcccgagctcacctggctcgtcgagtgcgagaccgtctgcgcccactgcggagcggacgcttttgctcccgagtcggtctttcttgcgcccaagctctacgccctgcaatccctcctctgtcccgcctgcggacgctcttccaagggcaagctccgcgccaagggccacgccgccgaggccctcaactacgagctcatggtcaactgctatctcgccgacgcgcagggcgaagaccgtgcccgtttcagcaccagcaggatgagtctcaagcgcacccttgcaagcgcccagccaggggcccaccccttcaccgtgacggagaccaccctcacgcggaccctgagaccctggaaggacatgacgctggccgcgctggacgcccatcgtctcgtgccctacagtcgcagtcgtcccaacccccgaaacgaggaagtctgctggatcgagatgccgtag

SEQ ID NO: 1039 - DNA, 1047 bp, Adenovirus D17
  MISC_FEATURE (1)..(1047): D17.orf00047 pIVa2 protein
atgcccatggccgacggactcaagcccctgaaaaactttgcttccctgcaagagctcctctcgctgggcggggaccgcctcctcggcgagctcgtccgggaaaacctccaagttagagacatgctcaacgaggtggcccccctcctccgggacgacggcagctgcatgtccttgaactaccacctgcaacccgtcatcggggtcatctacggcccgaccgggtgcggcaagtcccagctgttgagaaacctgctctcctcgcagctcatcacccccgccccggaaaccgtttttttcatcgccccgcaggtggacatgatccccccctccgagatgaaagcctgggagatgcagatctgcgaggggaacttcgccccggggcccgagggaaccatcgtcccccaatctggcaccctccgcccaaaattcattaaaatgtcttatgatgatctcacccaggagcataattatgatgtctctgaccccagaaacgtctttgccaaagccgcagcccacgggcccatcgccatcatcatggatgagtgcatggaaaacctgggcgggcacaagggcgtctccaaattcttccacgcattcccttccaagttgcatgataagttccccaagtgcacgggctacaccgtcctggtggtcctgcacaacatgaacccccggcgggatctgggtggcaacatcgccaacctcaagatccaggccaaactgcacatcatctccccccgcatgcatccctcccagctcaaccgctttgccaacacctacaccaaggggctccccgtggccatcagtctcctcctcaaggacatcatccagcaccacgcccagcgcccctgctatgactggatcatctacaacacgaccccagagcacgaggccatgcagtggtgctacctccacccccgggacgggctcatgcccatgtacctcaacatccaatcccacctctaccgggtcttggaaaaaatccaccgcactctcaatgatcgggagaggtggaccagggcctaccgcgcgcgaaaaaataaataa

SEQ ID NO: 1040 - DNA, 402 bp, Adenovirus D17
  MISC_FEATURE (1)..(402): D17.orf00050 IX pIX
atgaacgggaccggcggggccttcgaaggggggctttttagcccttatttgacaacccgcctgccaggatgggccggagttcgtcagaatgtgatgggatcgacggtggacgggcgcccagtgcttccagcaaattcctcgaccatgacctacgcgaccgtggggaactcgtcgcttgacagcaccgccgcagccgcggcagccgcagccgccatgacagcgacgagactggcctcgagctacatgcccagcagcagcagtagcccctctgtgcccagttccatcatcgccgaggagaaactgctggccctgctggccgagctggaagccctgagccgccagctggccgccctgacccagcaggtgtccgagctccgcgaacagcagcagcaaaataaatga

SEQ ID NO: 1041 - DNA, 1488 bp, Adenovirus D17
  MISC_FEATURE (1)..(1488): D17.orf00052 E1B 55 kDa protein
atggagccagaacacccaactgagcaggggctacattctggacttcgcagccatgcacctgtggagggcatgggtcaggcagcggggacagagaatcttgaactactggcttctacagccagcagctccgggtcttcttcgtctacacagacaaacatccatgttggaggaagaaatgaggcaggccatggacgagaacccgaggagcggtctggaccctccgtcggaagaggagttggattgaatcaggtatccagcctgtacccagagcttagcaaggtgctgacatccatggccaggggagtgaagagggagaggagcgatgggggcaataccgggatgatgaccgagctgacggccagtctgatgaatcgcaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcattgataccctggacaaggccgcctttaggtgttgcatgatgggaatgagagccggagtgatgaatatgaattccatgatctttatgaacatgaagttcaatggagagaagtttaatggggtgctgttcatggccaacagccacatgaccctgcatggctgcgactttttcggctttaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgaggcactgctcttccctggagacgggctgcttctgcctggtgaagggcacagcctctctgaagcataatatggtgaagggctgcacggatgagcgcatgtacaacatgctgacctgcgactcgggggtctgtcatatcctgaagaacatccatgtgacctcccaccccagaaagaagtggccagtgtttgagaataacatgctgatcaagtgccacatgcacctgggcgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattag

SEQ ID NO: 1042 - DNA, 207 bp, Adenovirus D17
  MISC_FEATURE (1)..(207): D17.orf00056 E1A 14.8 kDa protein
gtgtcagaggatgagtcatcaccctcagaagaagaccacccgtgtccccctgagctgtcaggcgaaacgcccctgcaagtgcacagacccaccccagtcagacccagtggcgagaggcgagcagctgttgaaaaaattgaggacttgttacatgacatgggtggggatgaacctttggacctgagcttgaaacgtcccaggaactag

SEQ ID NO: 1043 - DNA, 588 bp, Adenovirus D17
  MISC_FEATURE (1)..(588): D17.orf00057 E1A 28.2 kDa protein
gtgagaaaaatgagacacctgcgcctcctgcctggaactgtgcccttggacatggccgcattattgctggatgactttgtgagtacagtattggaggatgaactgcaaccaactccgttcgagctgggacccacacttcaggacctctatgatttggaggtagatgcccaggaggacgacccgaacgaagatgctgtgaatttaatatttccagaatctctgattcttcaggctgacatagccagcgaagctctacctactccacttcatactccaactctgtcacccatacctgaattggaagaggaggacgagttagacctccggtgttatgaggaaggttttcctcccagcgattcagaggacgaacagggtgagcagagcatggctctaatctcagactatgcttgtgtggttgtggaagagcattttgtgttggacaatcctgaggtgcccgggcaaggctgtaaatcctgccagtaccaccgggataagaccggagacacgaacgcctcctgtgctctgtgttacatgaaaaagaacttcagctttatttacagtaagtggagtgaatgtgagagaggctga

SEQ ID NO: 1044 - DNA, 378 bp, Adenovirus D20
  MISC_FEATURE (1)..(378): D20.orf00002 E4 ORF1 protein
atggctgaatctctgtatgctttcatagatagccctggagggattgctcccgtccaggaagggactagcaatagatataatttcttttgccctcaatctttccacattcctccgcatggggtggtattgcttcacctaaaagtgagtgtgctggttcctactggatatcagggcagatttatggccttgaatgactaccatgccagggacatactaacccagtccgatgtgatctttgccgggagaagacaggagcttactgtgctgctctttaatcacacggaccgatttttgtatgttcgcaagggccacccagtgggtaccctgctgctggagagagtgatttttccttcagtgaaaatagccaccttagtttag

SEQ ID NO: 1045 - DNA, 393 bp, Adenovirus D20
  MISC_FEATURE (1)..(393): D20.orf00003 E4 ORF2 protein
atgcttcagcgacgcggtgtaagctaccacattgtggtccctggggtcctagtgacttatttagaggacttttctattacgcaaatgattaaagaaaaactaccacgctttatcacttacattttggaaggcatcaccggagacacaaagagagcttattccagcatgcagtttttgggtgctagctttggagcattaaagttttccctcacgcttgccagtcccacgcttagccctggctctgaattgtcagctgtagtggcccaggacttaagtgactttttgcagctgacattgaggcgtgagctcagggcggagggcagaaccttattgaatcttgttgttttgaacacgctgcaggtggtggagcagcaggatctgtttctattatga

SEQ ID NO: 1046 - DNA, 354 bp, Adenovirus D20
  MISC_FEATURE (1)..(354): D20.orf00005 E4 13.6 K E4 ORF 3 13.6 kDa protein
atgaaggtctgcctgattatgaaagtggagggggcactgtgggagcttttccacatgtgcggagtggacttacatcaacaatttgtagaaataatccaaggctggaaaaatgagaattacctggggatggtgcaggaatgtaacctgatgattgatgaaatcgatggagggccagcctttaatgtgattcttatgttggatgtacgcgtagagccactgctcgaagccacagtcgagcaccttgaaaatagagtgggttttgatctggctgtatgtttccaccagcacagcggcggggaacgctgtcacctgcgtgacttgcactttatcgtccttcgagaccgcttggaataa

SEQ ID NO: 1047 - DNA, 879 bp, Adenovirus D20
  MISC_FEATURE (1)..(879): D20.orf00009 E4 34.1 kDa protein
atgcaaaccgagattcaatccagctcgctccgccatcatccatatcgcagggcccgtttaccacgatctgatgaggagaccagggcttcactgactgaacaacatcccctgttgcccgattgtgatcatgcagattatcataatgtaagttctgtccgtggattaccatgtgctgctggctttaccctgctccaagagtttccagtcccctgggatatgatcctgaccccagaggaaataaaaattttaaaaagatgtatgtcagtgtgcctgtgccccgctaccctggacttggtaagagctcagatggtgagcgggtacgagcgctggatcctgcattgccactgttcatccccgggctctctgcagtgtcgggcgggaggcaccctgctggccgtgtggttcaggagagtcatttacgggtgcatgttcaaccagcgtttcccatggtaccgtcagattgtgaacagagacatgcccaaagagatcatgtatatgggcagtgtgtttatgaggggcaggcacctgatatactgccgcatctggtacgacggtcacgtgggttccatcatccccaacatgagctttggctggagcaccctgaattatgggctgctgaataacatggtgattatgtgctgcacttactgtgagaacatggcagagatcaggatgcggtgctgtgcccgacgcaccaggagactgatgctaaaggctgtggggatcatagtcaaagagacttgcgatcccgatcccatctgcagcagccgcaccgagccccggcggcagagactgctaagggcgctgatggagaggcacagacccatcctgttttccgagtatgaatctgtgcgttcttctcgttccaccagactgtga

SEQ ID NO: 1048 - DNA, 123 bp, Adenovirus D20
  MISC_FEATURE (1)..(123): D20.orf00011 E4 ORF6/7 protein
atgaattatgtatctttattgatttttacaccagcacgggtagtcagtctcccaccaccagcccatttcacagtgtacacggttctctcagcacgggtggccttaaatagggaaatgttctga

SEQ ID NO: 1049 - DNA, 1140 bp, Adenovirus D20; identical to SEQ ID NO: 151
  MISC_FEATURE (1)..(1140): D20.orf00013 L5 fiber

SEQ ID NO: 1050 - DNA, 150 bp, Adenovirus D20
  MISC_FEATURE (1)..(150): D20.orf00014 U protein
atgaaaattgtggaccaagaatttgacatccctttcaaggtgtggaggaagtttgccgcccgccggggactggagtaccagagctgggaggagggcaccgaggtgctgctgaacaactacaccagagacatactttcagatttcaagtga

SEQ ID NO: 1051 - DNA, 393 bp, Adenovirus D20
  MISC_FEATURE (1)..(393): D20.orf00016 E3 14.7 kDa protein
atgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctgctcaagaccctttgcggactccgcgacctcctccccatgaactga

SEQ ID NO: 1052 - DNA, 393 bp, Adenovirus D20
  MISC_FEATURE (1)..(393): D20.orf00018 E3 RID-beta
atgcagactctgctcatactgctagccctcctatcccctgtcctcacaacttatgctgattactctaaatgcaaattcgcggacatatggaatttcttagattgctatcaggagaaaattgatatgccatcctattacttggtgattgtgggaatagtcatggtctgctcctgcactttctttgccatcatgatctacccctgttttgatctcggttggaactctgttgaggcattcacatacacactagaaagcagttcactagcctccacgccaccacccacaccgcctccccgcagaaatcagtttcccatgattcagtacttagaagagccccctccccggcccccttccactgttagctactttcacataaccggcggcgatgactga

SEQ ID NO: 1053 - DNA, 276 bp, Adenovirus D20
  MISC_FEATURE (1)..(276): D20.orf00019 E3 10.4 K E3 ORF 4 10.4 kDa protein
atgattcctaggttcttcctatttaacatcctcttctgtctattcaacatctgcgctgccttcgcggccgtctcgcacgcctcgcccgactgtctagggcctttccccacctacctcctatttgccctgctcacctgcacctgcgtctgcagcattgtctgcgtggtcatcaccttcctgcagctcatcgactggtgctgcgcgcgctacaattacctgcatcatagtcccgaatacagggacgagaacgtagccagaatcttaaggctcatctga

SEQ ID NO: 1054 - DNA, 801 bp, Adenovirus D20
  MISC_FEATURE (1)..(801): D20.orf00021 E3 CR1-gamma
atgaaggctttcacagcttgcgttctgattagtttagtcacacttagtctatctcaaattatcaatgttaatgttaccagaggtggtagcatcacattaaatggaacctatccgcaaactacatggacaagatatcacacaaatggatggaaaaaaatatgtgaatggaatgttacagcctataaatgcttcagtaatggaagcattacaattactgccactgctaatattacttctggcaaaatcaaggcagaaagctataaaaatgaaattaagaaaatggtatataggaataacaagacaacatttgaagattctggagattatgaatatcagaaattatctttttatatgctaacaattattgagcttccaactactaaggctcccaccacaattaggacaactgttgagaccactactcacactacgcagttagacactacagtacagaatagtactgtattggttaggtttttgttgagggaggaaagtactactgaacagacagaggctacctcaagtgccttcagcagcactgcaaatttaacttcgcttgcttggactaatgaaaccggagtatcattgatgcatggccagccttactcaggtttggatattcaaattacttttctggttgtctgtggaatctttattcttgtggttcttctgtactttgtctgctgcaaagccagagagaaatctaggaggcccatctacaggccagtgattggggaacctcagcccctccaagtggatggaggcttaagaaatcttctcttctcttttacagtatggtga

SEQ ID NO: 1055 - DNA, 1275 bp, Adenovirus D20
  MISC_FEATURE (1)..(1275): D20.orf00022 E3 CR1-beta
atgaatacagtgatccgtatcgtgctgctctctcttcttgtagcttttagtcaggcagaatttcatactatcaatgctacatggtgggataatataactttagtgggaccctcagatattccagtcacatggtatgatagcactggattgaaattttgtgatggaagtacagttaagaatccacagatcagacatagttgtaatgaacaaaacttaactctgattcatgtgaacaaaacccatgaaagaacatacatgggctataataaacagagtactcataaggaagactataaagttatagtaatacctcctcctcctcctgctactgtaaagccacaaccagaaccagaatatgtgtttatttatattggagacaacaaaactctagaaggtcctccaggtcctccagtcacttggtttaatcaggatggaaagaaattttgcgaaggggaaagagtttatcatccagaatacaatcacacatgtgacaaacaaaaccttatactgctgtttgtaaattttacacatgatggagcttatcttggttacaattatcaaggaactcaaaggacacagtatgaggttacagtcttagatctttttccaaactctggtcaaatgaaaattgaagaacatagtgaggaaacagaacaaaagaatgggcaaaagcaaaatgaagaacaaaaacatggtgatcaaaaaacaagtcaaacaaaagttaatgacaggcgaaaagcagcgcagaaaagaccatcaaagctaaaaccagcaactattgagacaatgcttgttacagtaactgctggttctaacttaactttagttgggcctaaaccagaaggaaaagttacttggttcgatggagatttaaaaagaccatgtgagcctaattatagactgagacatgaatgtaatactcaaaacttaactctaatcaatgtaactaaaggttatgagggaacttactatggtactaatgacaaagatgaaggcaaaaggtacagagtgaaagtaaatactacaaattctcaagctgtaaaaattcagccatataccagacctactactcctgatcagaatcacaaatttgaaatgcaaattgaaaatggaaatgacgaatcaaaaataccctcaactactgtggcaattgtggtgggtgtgattgcgggcttcataactctaatcattgtctttatatgctacatctgctgccgcaagcgtcccaggtcatacaatcatatggtagacccactactcagcttctcttactga

SEQ ID NO: 1056 - DNA, 474 bp, Adenovirus D20
  MISC_FEATURE (1)..(474): D20.orf00025 E3 gp 17.6 kDa protein
atgaaggggctcttgctgattatcctttccctggtggggggtgtactgtcatgccacgaacagccacgatgtaacatcaccacaggcaatgagaggagtgtgatatgcacagtagtcatcaaatgcgaacataaatgccctctcaacatcacattcaaaaaccgtaccatggggaatgcatgggtgggcgactgggaaccaggagatgagcagaactacacggtcactgtccatggtagcaatggaaatcacactttcggtttcaaatttatttttgaagttatgtgtgatatcacactgcatgtggctagacttcatggcttgtggccccctaccaaggataacatggttgggttttctttggcttttgtgatcatggcctgtgcaatgtcaggtctgctggtaggggctataatgtggttcctgaggcacaagcccaggtacggaaatctggaaaaggaaaaattgctataa

SEQ ID NO: 1057 - DNA, 597 bp, Adenovirus D20
  MISC_FEATURE (1)..(597): D20.orf00026 E3 CR1-alpha
atgagaatttttgctgtactctgtgtgctgagtttaataaaagctaaactcctacaatactctgggatcccgtgtcgtcgcactcgcaacgagaccttcaacctcaccaaccagactgaggtaaaactcaactgcaagccaggagataaatatatcctctggctctttgaaaacacttcattcgcagtctccaacacctgcgccaacgacggtattgaaatacccaacaaccttaccagtggactaacttacactaccagaaagactaagctagtactctacaatccttttgtagagggaacctaccactgccagagcggaccttgcttccacactttcactttggtgaacgttaccgacagcagcacagccgctccagaaacatctaaccttctttctgatactaacactcctaaaaccggaggtgagctctgggttccctctctaacagaggggggtaaacatattgaagcggttgggtatttgattttaggggtggtcctgggtgggtgcatagcggtgctgtattaccttccttgctggatcgaaatcaaaatctttatctgctgggtcagacattgttgggaggaaccatga

SEQ ID NO: 1058 - DNA, 321 bp, Adenovirus D20
  MISC_FEATURE (1)..(321): D20.orf00027 E3 12.2 kDa protein
atgtcccatggtgactcggctgagcttgctcggttgaggcatctggaccactgccgccgcctgcgctgctttgcccgggagagctgcggactcatctactttgagtttcccgaggagcaccccaacggacctgcacacggagtgcggatcaccgtagagggcaccaccgagtctcacctggtcaggttcttcacccagcagcccttcctggtcgagcgggaccggggcgccaccacctacaccgtctactgcatctgtccaaccccgaagttgcatgagaatttttgctgtactctgtgtgctgagtttaataaaagctaa

SEQ ID NO: 1059 - DNA, 684 bp, Adenovirus D20
  MISC_FEATURE (1)..(684): D20.orf00028 L4 pVIII
atgagcaaggagattcccaccccttacatgtggagctatcagccccagatgggcctggccgcgggcgcctcccaggactactccacccgcatgaactggctcagtgccggcccttcgatgatctcacgggtcaacggggtccgtaaccatcgaaaccaaatattgttggaacaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagcttaacgacgagttggtgagctcttcgatcggtctgcgaccggacggagtgttccaactagccggagccgggagatcgtccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactga

SEQ ID NO: 1060 - DNA, 219 bp, Adenovirus D20
  MISC_FEATURE (1)..(219): D20.orf00029 L4 20 kDa protein
ttgaccaccagagagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaa

SEQ ID NO: 1061 - DNA, 2199 bp, Adenovirus D20
  MISC_FEATURE (1)..(2199): D20.orf00033 L4 100 kDa protein
atggaggagcagccgcgtaagcaggagcaggaggaggacttaaccacccacgagcaacctaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctagccgaccggagcgaaacccccctcagcgtcgaggagctgtgtcgggcctacgagctcaacctcttctcgccgcgcgtgccccccaaacgccagcccaacggcacatgcgagcccaacccgcgtcttaacttctatcccgtctttgcggtccccgaggccctggccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggcttggtcgggacgagacgcgcgcggcaaatgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaagccctcgatgaaagtcaggagcagcgccccgaggacgcccggcccgtggtcagcgacgagcagctcgcgcgttggctcgggacccgcgacccccaggctttggaacagcggcgcaagctcatgctggccgtggtcctggtcaccctcgagctcgaatgcatgcgccgcttcttcagcgaccccgagaccctgcgcaaggtcgaggagaccctgcactacacttttagacacggtttcgtcaggcaggcatgcaagatctccaacgtggagctgaccaacctggtctcctgcctggggatcctgcatgagaaccgcctggggcagaccgtgctccactctaccctgaagggcgaggcgcggcgggactatgtccgcgactgcgtctttctctttctctgccacacatggcagtcggccatgggagtgtggcagcagtgtctcgaggacgagaacctgaaggagctggacaagcttcttgctagaaaccttaaaaagctgtggacgggcttcgacgagcgcaccgtcgcctctgacctggccgagatcgtgttccccgagcgcctgaggcagacgctgaaaggcgggctgcctgacttcatgagccagagcatgttgcaaaattaccgcactttcattctcgagcggtctgggatgctgcccgccacctgcaacgccttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgcccgcagcacgcggatctcacggcctgcgtcatcacccagggcgcgatccttgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgcagctccggccaagcctcctcgtag

SEQ ID NO: 1062 - DNA, 1470 bp, Adenovirus D20
  MISC_FEATURE (1)..(1470): D20.orf00034 E2A DNA-binding protein
atggccggcggcagtcaggacgtgcgccggttcatggaccgagaggccactccgccccggggccacggttcagcgcgctatccgccggagcaggaaaggagcccctcgccgccgcctcctctgcccaccaagcgccgaaagtatcagcgggtgggctccgggtcttccgaggaggacgtggtccccgtggacagccctccaaaaaagaagcagcccagaaagaccaagcatgtgaccaaggtagaccccgacgaagagatgccccaggaagatgccgtgatcgtgggagtgggattcagccagccgccggttctgttgaaggaaggcaaggacggaaaacgcatcgtcgagccagcgacccccggtgtcctaaacgtgcgcaaccccctgagtctgcctctggtctcgtcttgggagaagggcatggataccatgaacgtgctgatggaacgctaccgcgtcgacagcggcctgcgcgatgcttacaagctcatgcccgagcagaccgagatcttccaaaagatgtgccagacctggatgaacgaggaggcccgcggtctgcaactgaccttcaccacccagaaagcatttagcaccatcatgggtcgcctcttgcaaggttacatcttcagccacagcgggatcgcgcacaagaactgggagtgcaccggatgcgtcctgtgggatcacggctgcaccgaggtggaaggccagctcaagtgtctgcatggaacggtgatgattcacaaggaccacgtggtggagatggatgtaaccagtgagaacgggcagcgcgcgctgaaggagcaacccagcaaggccaaggtgacccagaaccgctggggacggagcgtggtgcaactgaccagccatgacgcgcgctgctgcgtgcaggatgccggatgcgggaataaccagttcagcgggaagagctgcggcctgtttttcagcgagggggccaaggcccagcaagctttcaagcagatcgcggcctttgtcaaggccctctacccgaatatgcagcgcggcgcgggaatgatgctaatgcccgttcactgcgagtgtaaccacaagcctcagagcgtgcccttcctgggccgccagctgtgcaagatgaccccgttcggcctcagcaacgccgaggacctggacaaggatcagatcagcgacaagagcgtgcttgccagtgtgaagtaccccagtctgatggtgttccagtgctgcaaccccgtgtaccgcaactcgcgcgcgcaaaacaccggccccaactgcgatttcaagatctccggcccggacatgctgggcgccctgcagatgagccggcgcatgtggagcgagaccttccccgagaccccagtgcccaaactggtgatccccgagttcaagtggcagcccaagtaccagtaccgcaacgtggccctccccagcgcggcgcacaacgacgagcgcgagaacccctttgacttttaa

SEQ ID NO: 1063 - DNA, 630 bp, Adenovirus D20
  MISC_FEATURE (1)..(630): D20.orf00035 L3 23.6 kDa protease
atgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgcctttggctggaacccgcgctcgcgcacctgctacatgttcgacccctttgggttctcggaccgccggctgaagcagatttacagcttcgagtacgaggccatgctacgccgcagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctacccaccctccggcgcaaccaggaggagctctaccgcttcctcgcgcgccactccccttactttcgatcccaccgcgccgccatcgaacacgccaccgcttttgataaaatgaaacaactgcgtgtatctcaataa

SEQ ID NO: 1064 - DNA, 2817 bp, Adenovirus D20; identical to SEQ ID NO: 211
  MISC_FEATURE (1)..(2817): D20.orf00037 L3 hexon

SEQ ID NO: 1065 - DNA, 651 bp, Adenovirus D20
  MISC_FEATURE (1)..(651): D20.orf00038 L3 pVI
atgggcacctggaacgagatcggcaccagccagctgaacgggggcgccttcaattggagcagtgtctggagcgggcttaaaaatttcggctcgacgctccggacctatgggaacaaggcctggaatagtagcactgggcagttgttaagagaaaagctcaaagatcaaaacttccagcagaaggtggtggacgggctggcctctggcattaacggggtggtggacatcgcgaaccaggccgtgcagcgcgaaataaacagccgcctggacccgcggccgcccacggtggtggagatggaagatgcaactcctccgccgcccaagggcgagaagcggccgcggccagatgcggaggagacgatcctgcaggtggacgagccgccctcgtacgaggaggccgttaaggccggcatgccgaccacgcgcatcatcgcaccgctggccacgggtgtaatgaaacccgccacccttgatctgcctccaccacccacgcccgctccaccgaaggcagctccggttgtgcagccccctccggtggcgaccgccgtgcgccgcgtccccgcccgccgccaggcccagaactggcagagcacgctgcacagtatcgtgggcctgggagtgaaaagtctgaagcgccgccgatgctattga

SEQ ID NO: 1066 - DNA, 1002 bp, Adenovirus D20
  MISC_FEATURE (1)..(1002): D20.orf00040 L2 pV
atgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagtttgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgaaaacatgtatccgaccatgcagatcatggtgcctaagcgcaggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgtctccacttctaccgccgccacggccaccgagcctcccaggaggcgaagatggggccccgccaaccggctgatgcccaactacgtgttgcatccttccatcatcccaacgccgggctaccgcggcacccggtactacgccagccgcagacgcccagccagcaaacgccgccgccgcaccacccgccgccgtctggcccccgcccgcgtgcgccgcgtaaccacgcgccggggccgctcgctcgttctgcccaccgtgcgctaccaccccagcatcctttaa

SEQ ID NO: 1067 - DNA, 591 bp, Adenovirus D20
  MISC_FEATURE (1)..(591): D20.orf00041 L2 pVII
atgtctattctcatctcgcccagcaataacaccggctggggtcttactaggcccagcaccatgtacggaggagccaagaagcgctcccagcagcaccccgtccgcgtccgcggccacttccgcgctccctggggagcttacaagcgcgggcggactgccaccgccgccgccgtgcgcaccaccgttgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagtacgcccgccatgcgcgccgcccgggctctgctgcgccgcgccagacgcacgggccgccgggccatgatgcgagccgcgcgccgcgccgccactgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctga

SEQ ID NO: 1068 - DNA, 1560 bp, Adenovirus D20; identical to SEQ ID NO: 181
  MISC_FEATURE (1)..(1560): D20.orf00042 L2 penton

SEQ ID NO: 1069 - DNA, 1608 bp, Adenovirus D20
  MISC_FEATURE (1)..(1608): D20.orf00044 L1 pIIIa
atgcaacgcatcatggccctgacgacccgcaaccccgagtcctttagacaacagccgcaggccaacagactttcggccattctggaggcggtggtcccctctcggaccaaccccacgcacgagaaggtgctggcgatcgtgaacgcgctggcggagaacaaggccattcgtcccgacgaggctgggctggtatacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattataccaactttatcagcgcgctgcggctgatggtgaccgaggttccccagagcgaggtgtaccagtcgggcccggactactttttccagactagcagacagggcctgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagtgtgaaccgcaactcgtacctgggtcacctgctgacgctgtaccgcgaggccataggccaggcacaggtggacgagcagaccttccaggagatcactagtgtaagccgcgcgctggggcagaacgacaccgacagtctgagggccaccctgaacttcttgctgaccaatagacagcagaagatcccggcgcagtatgcgctgtcggccgaggaggagcgcatcctgagatatgtgcaacagagcgtagggctgttcctgatgcaggagggggccacccccagcgccgcgctggacatgaccgcgcgcaacatggaacctagcatgtacgccgccaaccggccgtttatcaataagctgatggactacctgcaccgcgcggcgtccatgaactcggactactttaccaatgccattttgaacccgcactggctcccgccaccggggttctacacgggcgagtacgacatgcccgaccccaacgacgggtttctgtgggacgatgtggacagcgcggtgttttccccgaccttgcaaaagcgccaggaggcggtgcgcacgcccgcgagcgagggcgcagtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggagcctgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccagactggggcgacggatgttttga

SEQ ID NO: 1070 - DNA, 1125 bp, Adenovirus D20
  MISC_FEATURE (1)..(1125): D20.orf00046 L1 52 kDa protein
atgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgagtgcagctgcaaaaggacgtgcgcccggcgtacgtgcctgcgcagaacctgttcagggaccgcagcggggaggagcccgaggagatgcgcgactgccgttttcgggcgggcagggagctgcgcgagggcctggactgccagcgcgtgctgcgcgacgaggatttcgagccgaacgagcagacggggatcagccccgcgcgcgctcacgtggcagcggccaacctggtgacggcctacgagcagacggtgaagcaggagcgcaacttccaaaagagtttcaacaaccatgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggccgctggctgctggagctgattaacatcttgcagagcattgtagtgcaggagcgcagcctgagcttggccgagaaggtggcggctatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcattcacaaggccgtgagcacgagccggcggcgcgagctaagcgaccgcgagttgatgctgagcctgcgccgggcgctggtagggggcgcctccggcggcgaggagtcctacttcgacatgggggcggacctgcattggcagccgagccggcgcgccttggaggccgtctatggtccagaggacttggatgaggaagaggaagaggaggaggatgcacccgttgcggggtactga

SEQ ID NO: 1071 - DNA, 1854 bp, Adenovirus D20
  MISC_FEATURE (1)..(1854): D20.orf00048 pTP
atggactatttcctgccgctgcgcaacatatggaaccgcgtccgcgagttcccgcgcgcctccaccaccgccgccggcatcacctggatgtcccgctacgtctacggctaccaccgcctcatgctcgaggacctggccccgggcgcgccggccacccagcgctggccgctctaccgccagccgccgccgcactttctagtcggataccagtacctcgtgcgcacctgcaacgactacgtattcgactcgcgcgccttctcgcggctcaggtactcggaggtcgtgcagcccggcttgcagaccgttaactggtcgctcatggccaactgcacctacaccatcaacacaggggcctaccaccgcttcgtcgacatggacgacttccaggacaccctcacccgcgtgcaacaggccatcctcgccgagcgcgtcgtcgccgacctggcgctcgtgcagccgctcaggggcgtcggggtcacccgcatggaagactctgcctccgccagtgatgacattgaaaggctcatgcatgactactacaagaacctgagccggtgtcagggccaggcctggggcatggccgagcggctccgcatccagcaagcgggacccaaggacctggtcctcctcgccaccatccgccgcctcaaaaacgcctacttcaattacatcatcagcaaccgcaattctaacagcgtccacagggctgctacgtgtttgagcttaccttgcgactgcgattggctagacgctttcctcgaaagattctccgatccggtcgatctcgacgcgctcacgtcccctacaccgcaattgataagatgcatcgtcagcgccctctcgctgcccaacggggacccgccccattaccgggagatgaccggcggcgtcttcacgctgcgtcctcgcgaacggggtcgcgccgtaaccgaaaccatgcgtcgccgccgcggggagatgatcgagcgcttcgtcgaccgtctcccggtgcgtcgccgtcgtcgtcgcgccccgccaccaccaccgcccccagaggaagaaatagaagaagaggtcgtcatggaagaagaggaagaggaggagacccccggggatttcgagcgcgaggtgcgcgccaccatcgccgagctcatccggctcctggaagacgagctcacggtctcggcccgcaacgcccagtttttcaacttcgccgtggacttctacgaggccatggaaaggctggaggccatcggcgacatcagcgagatgcccctgcgccgctggatcatgtacttcttcgtcaccgagcacatcgccaccaccctcaactacctcttccaacgcctgcgcaactacgctgtcttcacgcggcacgtggagctcaacctcgcgcaggtggtcatgcgcgcgcgcaacgccgacggggacgtggtctacagccgcgtctggaacgagagcggcctgggcgccttctcgcagctcatgggtcgcatctccaacgacctcgccgccaccgtcgagcgcgcgggccgcggcgatctccaggaggaggagatcgaacagttcatgtccgagatcgcctaccaggacaactcgggcgacgtgcaagagatcctgcgtcaggccgccgtcaatgacgccgagattgattctgttgaactgtctttcaggttcaaagtcacggggccagtggtcttcacacagaggcggcagatccaggatgtcaaccgccgcgtcgtcgcgcacgccagcgctctcagggcgcagcaccgggacctgcccgagcgccacgccgaagtgcctctgccgcccctgcccgcggggccggaaccgccgctgccgccgggagcgcgtccgcgacaccgcttctaa

SEQ ID NO: 1072 - DNA, 3276 bp, Adenovirus D20
  MISC_FEATURE (1)..(3276): D20.orf00051 E2B DNA polymerase
atgcaatgcgtggacacggccaccaactcacccgtagaaatcaagtaccatctgcatctcaagcacgccctcacccgcctctacgaggtcaacctcagaaccctgccccctgacctggatctccgcgacaccatggacagctcccaactgcgcgcccttgtcttcgctctccgcccccgccgcgccgagatctggacctggctcccgcgcgggctcgtcagcctctccgtcctcgaggagccccagggtgagtcccacgcaggcgaacatgaaaaccaccagccagggccgccactcctgaagttcctcctcaagggacgcgctgtgtatctcgtggatgaggtacagcccgtgcagcgctgcgagtactgcggacgcttttacaagcatcagcatgagtgctcggttcgccggcgggatttctactttcatcacatcaacagccactcgtccaactggtggcaggaaatccagttcttcccaatcggctctcatcctcgcacggagcggctctttgtcacctacgatgtagaaacctacacctggatggggtccttcggcaagcagctcgtccccttcatgctggtcatgaaattctcgggggaccccgagctggtcgccctcgctcgcgatctcgccgtgcgcttacgctgggatcgctgggagcgtgaccccctcaccttctactgcgtcaccccagaaaagatggccgtgggccagcagttccgcctctttcgcgacgagctccagaccctcatggcccgcgagctctgggcttccttcatgcaagccaacccacatctccaggagtgggcgctcgagcagcacggcctgcaatgccccgaggacctcacctacgaggaactcaaaaagctgccgcacatcaaaggccgcccgcgattcatggaactctacatcgtcgggcacaacatcaacggcttcgacgagatcgtcctcgccgcccaggtcatcaacaaccgagcctccgtcccgggccctttccgcatcacccgcaatttcatgccgcgggcaggcaaaattctcttcaatgacgtcactttcgctctgcctaaccccctctcgaagaagcgcaccgatttcgagctctgggagcacggcggctgcgacgactcggacttcaagtaccagttcttgaaagtcatggtcagagacaccttcgccctgacgcacacctcgctccgcaaggccgctcaagcttacgccctccccgtggagaagggctgctgtccctacaaggccgtgaaccatttctacatgctgggctcttaccgtgcggacgatcgaggattcccgctccgggagtactggaaggatgacgaggagtacgccctcaaccgcgagctatgggagaagaaaggagaggcgggttatgacatcatccgcgaaacactggactactgcgccatggacgtcctcgtcaccgccgagctcgtcgccaagctgcaagactcctacgcgcacttcatccgcgactcggtccgcctgccccacgcccactttaacatcttccaacggcccaccatctcctcaaactcgcatgccatctttcgccagatcgtcttccgcgccgagcagccccagcgcaccaatctcggccccgccttcttggccccctcgcacgagttgtatgactacgtgcgcgccagcatccgcggggggcgctgttatcccacctacatcggcatcctctcggagcccatctatgtctacgacatctgcggcatgtacgcctccgccctcacacatcccatgccttggggtccgcccctcaacccctacgagcgagcgctggccgcccgcgagtggcagatggccttggatgatgcatccttaaaaatcgattattttgacaaggaactctgtccgggcatcttcaccatcgatgcggacccccccgacgagcacctcctggatgtgctgcccccgttttgctcgcgcaagggcggcagactctgctggaccaacgagcccctgcgcggcgaggtggccaccagcgtggacctggtcaccctgcataaccgcggctggcgcgtcaggatcgtgcccgacgagcgcaccaccgtcttccccgaatggaagtgcgtcgcgcgcgagtatgtccagctcaacatcgcggccaaggagcgcgccgaccatgacaaaaatcagaccatgagatccatcgccaagcttctctccaacgccctctatggctcctttgccaccaagcttgacaataaaaaaattgtcttttctgaccagatggatgaaagtttactcaaaagcatcgcggcagggcaggccaacatcaaatcctcctcgtttctagaaactgacaacctgagtgccgaggtcatgcccgttctcgagagggaatacctaccccaacagctggcgctcgtggacagcgacgcggaagagagtgaggacgagcacagacccgcccccttttatacccccccgtcggggaccccaggtcacgtggcctacacctacaagccaatcaccttcttggatgcggaggagggggacatgtgtctgcataccgtggaaaaggtggaccccctggtggacaacgaccgctacccctcgcacgtggcctcctttgtcttggcgtggacgcgcgcctttgtctcagagtggtccgagtttctctacgaggaggaccgcgggacgcccctgcaggacaggcccatcaagtccgtctacggggacacagacagcctgtttgtcaccgaacgcggacacagactcatggagacgcgaggtaagaagcgcatcaaaaagaacgggggaaaactggtttttgaccccgatcaccccgagctcacctggctcgtcgagtgcgagaccgtctgcgcccactgcggagcggacgccttcgcccccgagtccgtctttctagcgcccaagctctacgccctgcaatccctcctctgtcccgcctgcgggcgctcttccaaaggaaagctccgcgccaagggccatgccgccgaggcccttaactacgagctcatggtcaactgctatctcgccgacgcgcagggcgaagaccgtgcccgtttcagcaccagcaggatgagtctcaagcgcacccttgcaagcgcccagcccggggcccaccccttcaccgtgacggagaccaccctcactcggaccctgagaccctggaaggacatgacgctggccgcgctggacgcccatcgtctcgtgccctacagtcgcagtcgtcccaacccccgaaacgaggaagtctgctggatcgagatgccgtag

SEQ ID NO: 1073 - DNA, 1047 bp, Adenovirus D20
  MISC_FEATURE (1)..(1047): D20.orf00052 pIVa2 IVa2
atgcccatggccgacgggctcaagcccctgaaaaactttgcttcactgcaagagctgctttcgctgggcggggaccgcctcctcggcgagctcgtccgggaaaacctccaagtcagggacatgctcaacgaggtggcccccctcctccgggacgacggcagctgcatctccttgaactaccacctgcaaccagtcatcggggtcatctacggtccgaccgggtgcggcaagtcccagctgctgagaaacctcctctcctcgcagctcatcacccccgccccggaaaccgtctttttcatcgccccgcaggtggacatgattcccccctccgagatgaaagcctgggagatgcagatctgcgaggggaacttcgccccgggccccgagggaaccatagtcccccaatctggcaccctccgccccaaattcattaaaatgtcttatgatgatctcacccaggagcataattatgatgtctctgaccccagaaacgtctttgccaaagccgcagcccacgggcccattgccatcatcatggatgagtgcatggaaaacctgggcgggcacaagggcgtctccaaattcttccacgcattcccttccaagttgcatgacaagttccccaagtgcacaggctacaccgtcctggtggtcctgcacaacatgaacccccggcgggatctgggcggcaacatcgccaacctcaagatccaggccaaactgcacatcatctccccccgcatgcatccctcccagctcaaccgttttgccaacacctacaccaaggggctccccgtggccatcagtctcctcctcaaggacatcatccagcaccacgcccagcgcccctgctatgactggatcatctacaacacgaccccagagcacgaggccatgcagtggtgctacctccacccccgggacgggctcatgcccatgtacctcaacatccaatcccacctctatcgggtcctggaaaaaatccaccgcactctcaatgatcgggagaggtggaccagggcctaccgcgcgcgaaaaaataaataa

SEQ ID NO: 1074 - DNA, 402 bp, Adenovirus D20
  MISC_FEATURE (1)..(402): D20.orf00056 IX pIX
atgaacgggaccggcggggccttcgaaggggggctttttagcccttatttgacaacccgcctgccgggatgggccggagttcgtcagaatgtgatgggatctacggtggatgggcgcccagtgcttccagcaaattcctcgaccatgacctacgcgaccgtggggaactcgtcgctcgacagcaccgccgcagccgcggcagccgcagccgccatgacagcgacgagactagcctcgagctacatgcccagcagcggtagcagcccctctgtgcccagttccatcatcgccgaggagaaactgctggccctgctggccgagctggaagccctgagccgccagctggccgccctgacccagcaggtgtccgagctccgcgagcagcagcagcaaaataaatga

SEQ ID NO: 1075 - DNA, 1488 bp, Adenovirus D20
  MISC_FEATURE (1)..(1488): D20.orf00058 E1B 55 kDa protein
atggagccagaacacccaactgagcaggggctacattctggacttcgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcttgtacccagagcttagcaaggtgctgacatccatggccaggggagtgaagagggagaggagcgatgggggcaataccgggatgatgaccgagctgacggccagcctgatgaatcgcaagcgcccagagcgcattacatggcacgagctacagatggagtgcagggatgagttgggcctgatgcaggataaatatggcctggagcagataaaaacacattggttgaacccagatgaggattgggaggaggccattaagaaatatgccaagatagccctgcgcccagattgcaagtacatagtgaccaagaccgtgaatattagacatgcctgctacatttcgggtaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttctttggcttcaacaatatgtgcgccgaggtctggggcgcttccaagatcaggggatgtaagttttatggctgttggatgggcgtagtgggaagacccaagagcgagatgtctgtgaagcagtgtgtgtttgagaaatgctacctgggagtctctaccgagggcaatgctagagtgagacactgctcttccctggatacgggctgtttctgcctggtgaagggtacggcctctctgaagcataatatggtgaagggctgcacagatgagcgcatgtacaacatgctgacctgcgactcgggggtctgccatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaggtccagggtgcgcgcttgcgagtgcgggggcagacacaccaggatgcagcctgtggccctggatgtgacagaggagctgagaccagaccacctggtgatggcctgtaccgggaccgagttcagctccagcggggaggacacagattag

SEQ ID NO: 1076 - DNA, 225 bp, Adenovirus D20
  MISC_FEATURE (1)..(225): D20.orf00062 E1A 14.8 kDa protein
atgtcatgtaacaagtcctcaattttttcaacagctgctcgcctctcgccactgggtctgactggggtgggtctgtgcacttgcaggggcgtttcgcctgacagctcagggggacacgggtggtcttcttctgagggtgatgactcatcctctgacaccggacctagaaacaaaaataaaccacacttagcacagctgtttaagcatcacccagttatgtgttaa

SEQ ID NO: 1077 - DNA, 579 bp, Adenovirus D20
  MISC_FEATURE (1)..(579): D20.orf00063 E1A 28 kDa protein
atgagacacctgcgcctcctgtcttcaactgtgcctattgacatggccgcattattgctggaggattatgtgagtacaatattggaggacgaactgcatccatctccattcgagctgggacctacacttcaggacctatatgatttggaggtagatgcccatgatgacgacccgaacgaagaggctgtgaatttaatatttccagaatctctgattcttcaggctgacatagccagcgaagctgtacctacaccacttcatacaccgactctgtcacccatacctgaattggaagaggaggacgagctagacctccgatgttatgaggaaggttttcctcccagcgattcagaggacgaacagggtgagcagagcatgactctaatctcagaatatgcttgtgtggttgtggaagagcattttgtgttggacaatcctgaggtgcccgggcaaggctgtagatcctgccagtaccaccgggataagaccggagacacgaacgcctcctgcgctctgtgttacatgaaaaagaacttcagctttatttacagtaagtggagtaaatgtgagagagactga

SEQ ID NO: 1078 - DNA, 177 bp, Artificial Sequence
  D24.orf00004 hypothetical protein
atgttaacttttgtttactttgtggggtatattattgatgatgtttttctcagactctgggagcggagctcagagaaatctctactcgctggcactcaagagtggcctcttgacgggctcgactggtttaaataccctgtggatcagctgatctgtgacataaacaccggactttga

SEQ ID NO: 1079 - DNA, 378 bp, Adenovirus D24
  MISC_FEATURE (1)..(378): D24.orf00006 E4 ORF1 protein
atggctgaatctctgtatgctttcatagatagtcctggagggattgctcccgtccaggaagggactagcaatagatataattttttttgccctgaatctttccacattcctccgcatggggtggtattgcttcacctaaaagtgagtgtgctggttcctactggatatcagggcagatttatggccttgaatgactaccatgccagggacatactaacccagtccgatgtgatttttgccggaagaagacaggaacttactgtgctgctttttaatcacacggaccgatttttgtatgtccgcaagggccacccagtgggtaccctgttgttggagagagtgatttttccttcagtgaaaatagccaccttagtttag

SEQ ID NO: 1080 - DNA, 393 bp, Adenovirus D24
  MISC_FEATURE (1)..(393): D24.orf00007 E4 ORF2 protein
atgcttcagcgacgcggtgtaagctaccacattgtggtccctggggtcctagtgacttatttacaggacttttctattacgcaaatgattaaagaaaaactaccacgctttatcactcacattttggaaggcatcaccggagacacaaagagagcttattccagcatgcagtttttgggtgctagctttggagcattaaagttttcccttacgcttgccagtcccacgcttagccctggctctgaattgtcagctgtagtggcccaggacttaagtgattttttgcagctgacattgaggcgcgagctcagggcggagggcagaaccttattgaatcttgttgttttgaacacgctgcaggtggtggagcagcaggatctgtttctattatga

SEQ ID NO: 1081 - DNA, 354 bp, Adenovirus D24
  MISC_FEATURE (1)..(354): D24.orf00009 E4 13.6 K E4 ORF 3 13.6 kDa protein
atgaaggtctgcctgattatgaaagtggagggggcactgtgggagcttttccacatgtgcggagtggacttacaccaacaatttgtagagataatccaaggctggaaaaatgagaattacctggggatggtgcaggaatgtaacctgatgattgatgaaatcgatggagggccagcctttaatgtgattcttatgctggatgtacgcgtagagccactgctcgaagccacggtcgagcaccttgaaaatagagtgggttttgacctggctgtctgtttccaccagcacagcggaggggaacgctgtcacctgcgtgacttgcactttatcgtccttcgagaccgtttggaataa

SEQ ID NO: 1082 - DNA, 879 bp, Adenovirus D24
  MISC_FEATURE (1)..(879): D24.orf00014 E4 34 kDa protein
atgcaaaccgagattcaatccagctcgctccgccatcatccatatcgcagggcccgtttaccacgatctgatgaggaaaccagggcttcactgactgaacaacatcccctgttgcctgattgtgatcatgcagattatcataatgtaagttctgtccgtggattaccatgtgctgctggctttaccctgctccaagagtttccagtcccctgggatatgatcttgactccagaggaaataaaaattttaaaaagatgtatgtcagtgtgcctgtgccccgctaccctggacttggtgagagctcagatggtgagcgggtacgagcgctggatcctgcattgccactgttcatccccgggctccctgcagtgtcgggcgggaggcaccctgctggccgtgtggttcaggagagtcatttacgggtgcatgttcaaccagcgctttccctggtaccgtcagattgtgaacagagacatgcccaaagagatcatgtatatgggcagtgtgttcatgaggggcaggcatctgatatactgccgcatctggtacgatggtcacgtgggttccatcatccccaacatgagttttggctggagcaccctgaattatgggctgctgaataacatggtgattatgtgctgcacttactgtgagaacatgagcgagatcaggatgcggtgctgtgcccgacgcaccaggagactgatgctgaaggctgtggggatcatagtcagagagacttgtgatcccgatcccatctgcagcagccgcaccgagccccggcggcagagactgttgagggcgctgatggagaggcacagacccatcctgttttccgagtatgaatctgtgcgttcttctcgtttcaccagactgtga

SEQ ID NO: 1083 - DNA, 246 bp, Adenovirus D24
  MISC_FEATURE (1)..(246): D24.orf00016 E4 ORF6/7 protein
gtgaccttggactgtgaggcccgcttggatgacttttcagaggacggcttcatctcaatcaccgacccccgtttggctcgccaggaaactgtgtggattatagaccccaagtccagttcccgcactaatcagaacatttccctatttaaggccacccgtgctgagagaatcgtttacactgtgaaatgggctggtggtgggagactgactacccgtgctggtgtaaaaatcaataaagatacatga

SEQ ID NO: 1084 - DNA, 1146 bp, Adenovirus D24; identical to SEQ ID NO: 152
  MISC_FEATURE (1)..(1146): D24.orf00017 L5 fiber

SEQ ID NO: 1085 - DNA, 150 bp, Adenovirus D24
  MISC_FEATURE (1)..(150): D24.orf00018 U protein
atgaaaattgtggaccaggaatttgacatccctttcaaggtgtggaggaagttcgccgcccgccggggactggagtaccagagctgggaggagggttccgaggtgctgctgaacaactacaccagagacatactttcagatttcaagtaa

SEQ ID NO: 1086 - DNA, 390 bp, Adenovirus D24
  MISC_FEATURE (1)..(390): D24.orf00020 E3 14.6 kDa protein
atgactgaccacctggacctcgagatggacggccaggcctccgagcagcgcatcctgcaactgcgcgtccgacagcagcaggagcgggccgccaaggagctcctcgatgccatcaacatccaccagtgcaagaagggcatcttctgcctggtcaagcaggcaaagatcacctacgagctcgtgtccggcggcaagcagcatcgcctcgcctatgagctaccccagcagaagcaaaagttcacctgcatggtgggcgtcaaccccatagtcatcacccagcagtcgggcgagaccaacggctgcatccactgctcctgcgaaagccccgagtgcatctactccctcctcaagaccctttgcggactccgcgacctcctccccatgaactga

SEQ ID NO: 1087 - DNA, 393 bp, Adenovirus D24
  MISC_FEATURE (1)..(393): D24.orf00022 E3 RID-beta
atgcagcctctgctcatgctgatatccctcctatcccctgcccttgccacttctgctgattactctaaatgcaaattcgcggacatatggaatttcttagattgctatcaggagaaaattgatatgccctcctattacttggtgattgttggggtagtcatggtctgctcatgcactttctttgccattatgatctacccctgttttaatcttggctggaactctgttgaggcattcacatacacactagaaaacagttcactagcctccacgccaccacccacaccgcctccccgcagaaatcagttccctatgattcagtacttagaagagccccctccccggcccccttccactgttagctactttcacataaccggcggcgatgactga

SEQ ID NO: 1088 - DNA, 276 bp, Adenovirus D24
  MISC_FEATURE (1)..(276): D24.orf00023 E3 10.4 K E3 ORF 4 10.4 kDa protein
atgattcctaggttcttcctatttaacatcctgttctgtctcttcaacatctgtgctgccttcgcggccgtctcgcacgcctcgcccgactgtctagggcctttcccaacatacctcctctttgccctgctaacctgcacctgcgtctgcagcattgtctgcgtggtcatcacctttctgcagctcatcgactggtgctgcgcgcgctacaattatctccaccacagtcccgaatacagggacgagaacgtagccagaatcttaaggctcatctga

SEQ ID NO: 1089 - DNA, 846 bp, Adenovirus D24
  MISC_FEATURE (1)..(846): D24.orf00025 E3 CR1-gamma
atgaaggctttcacagcttgcgttctgtttaacataatcacacttagtgtagctgcaaatggttttaaacatgttaatgttaccagattaagtaatgtaacactgacaggagctggaattaatactacatggacagggtattttaatgagggtccaaaaggaaaaaatgggtggatgaatatttgcacatggggcgatcctagatatgtgtgccatggaaatagcagtactattactaatcttacagttgtggcacttctaaatttaaccactaacagaagatttaaagcagaaagttttactagtaacgatggttatgaaactaccagtgcaaaattttatgaaattaaaattattgagcttccaacaactagagcacccaccacagttaggacaacacagcctaccactgtgcccactacacatccaaccaccacagtcagtacaactattgagaccactactcatactacacagctagacacaacagtgcagaatactactttattgattgggtttttactgagaggaaatgaaagtactactgaacagacagaggctacctcaagtgccttcagcagcactgcaaatttaacttcgcttgcttggactaatgaaaccggagtatcattgatgaatcgacagccttactcaggtttggatattcaaattacttttctggttgtctgtgggatctttattcttgcggttcttctgtactttgtctgctgcaaagccagagagaaatctaggcggcccatatacaggccagtaatcggggaacctcagcctctccaagtggatggaggcttaaggaatcttctcttctcttttacagtatggtga

SEQ ID NO: 1090 - DNA, 1272 bp, Adenovirus D24
  MISC_FEATURE (1)..(1272): D24.orf00026 E3 CR1-beta
atgaatacagtgttccgtatcgtgctgctctctcttcttgtagctttcggtcaggcaggaattcatattattaatgctacatggtgggataatataactttagtgggaccctcagatactccagttacctggtatgatggcaagggattgcaattttgtgacggaagtacagttaagaatccgcagatcagacatacttgtaatgatcaaaacttaactctgattcatgttaacaaaacccatgaaagaacatacatgggttacagacatgacagtaagggaaaagtagactataaggttacagtcattccacctcctcctgctactgtaaagccacaaccagatccagaaaatgtctttgtttatatgggaaataatgtaactttagttggacctccaggaattccagttagttggtattatcataatggcacacagttctgcgatggagataaaattattcatccagaattcaaccacacctgtgataaacaaaaccttacactgctgtttgtaaactttacacatgatggaggctatcttggattcaattacaaaggtactcagagaattcagtatgaggttatagttttagatcgatttccaaattctggtcagatgaaaattgaagaacaaagtgaggaaacagaacagaaacatactgagcataataaggctggacaaaagcagggtatagatacaaatcaaaagaaagctaataacagacaaaagccatctcaaaggccatcaagaagacggccgacaaacactcctgagacaaaacaacttacagtgtctattgggtctaacttaactttagttggtccagatggaaaagtcacttggtatgatggtgatttaaaaagaccatgtgaagaacaaaactataggcttccacatcagtgtagtgctcagaacttaactttaattaatgtaactaaatctcatgagggaacttactatggcactaatgacaaagacgaaagcaaaagatacagagtgaaagtgaacactacaaattctcaagctgtaaaaattaacccatataccagacctactactcctgatcagaaacacagatttgaattacaaattgaaaataatgcaaatgatgaagaatcaaaaattccatctactactgtggcaatcgtggtgggagtgattgcgggcttcataactataatcattgtcattctgtgctacatctgctgccgcaagcgtcccagggcatacaatcatatggtagacccactactcagcttctcttactga

SEQ ID NO: 1091 - DNA, 471 bp, Adenovirus D24
  MISC_FEATURE (1)..(471): D24.orf00029 E3 gp 17.6 kDa protein
atgaaggggctcttgctgattatcctttccctggtggggggtgtgctgtcatgccacgaacagccacgatgtaacattaccacaggcaatgagaggaacgactgctctgtagttatcaaatgcgagcaccattgtcctctcaacatcacattcaagaataagaccatgggaaatgtatgggtgggattctggcaaccaggagatgagcagaactacacggtcactgtccatggtagcgatggcaatcacactttcggtttcaaattcatttttgaagtcatgtgtgatatcacactacatgtggctagacttcatggcttgtggccccctaccaaggagaacatggtgggtttttctttggcttttgtgatcatggcctgcttgatgtcaggtctgctggtaggggctctagtgtggtttctgaaacgcaagcccaggtacggaaatgaggagaaggaaaaattgctataa

SEQ ID NO: 1092 - DNA, 570 bp, Adenovirus D24
  MISC_FEATURE (1)..(570): D24.orf00030 E3 CR1-alpha
gtgagtttaataaaagctgaactaagaaccttctttggaatcccttgtcatcatcaaatcaacaagaccatcaacttcacctttgaggaacaggtgaactttacctgcaagccacacaagaagtacatcatctggttttatcacaacactactctagcagtagccaacacctgctcgaacgacggtgttctcctacctaacaatctcaccagtggactaaccttctcagttaaaagggcaaagctaattcttcatcgccctattgtagaaggaacttaccagtgtcagagcggaccttgcttccacagtttcactttggtgaacgttaccggcagcagcacagccgctccagaaacatctaaccttctttctgatactaacaaacctcgtgtcggaggtgagctttgggttccatctctaacagagggtgggagttctattgaagtggttgggtatttgattttaggggtggtcattggtgggtgcatagcagtgctgtatcaacttccttgctgggtcgaaatcagggtatttatctgctgggtcagacattgtggggaggaaccatga

SEQ ID NO: 1093 - DNA, 321 bp, Adenovirus D24
  MISC_FEATURE (1)..(321): D24.orf00031 E3 12.2 K E3 12.2 kDa protein
atgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggagctaccacctacaccgtctactgcatctgtcctaccccgaagttgcatgagaatttttgctgtactctttgtggtgagtttaataaaagctga

SEQ ID NO: 1094 - DNA, 684 bp, Adenovirus D24
  MISC_FEATURE (1)..(684): D24.orf00032 L4 pVIII
atgagcaaggagattcccaccccttacatgtggagctatcagccccagatgggcctggccgcgggcgcctcccaggactactccacccgcatgaactggctcagtgccggcccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagtttataccgaacttcgacgcagtgagagaagcggtggacggctacgactga

SEQ ID NO: 1095 - DNA, 186 bp, Adenovirus D24
  MISC_FEATURE (1)..(186): D24.orf00034 L4 22 kDa protein
gtgaagggtgacggtaagcacgagcggcagggctaccgatcatggagggtccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaa

SEQ ID NO: 1096 - DNA, 2199 bp, Adenovirus D24
  MISC_FEATURE (1)..(2199): D24.orf00035 L4 100 kDa protein
atggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctccagcatggctacctgggaggagaggaggatgtgctgctaaaacacttgcagcgccaatccatcatcctccgggacgccctggccgaccggagcgaaacccctctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggccctagccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcaaacgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagcagctcgcgcgttggctcgggacccgcgacccccaggctttggaacagcggcgcaagctcatgctggccgtggtcctggtcaccctcgagctcgaatgcatgcgccgcttcttcagcgaccccgagaccctgcgtaaggtcgaggagaccctgcactacactttcaggcacggtttcgtcaggcaggcctgcaagatctccaacgtggagctgaccaacctggtctcatgcctggggatcctgcacgagaaccgcctgggacagaccgtgctccactctactctgaagggcgaggcgcgtcgggactatgtccgcgactgtgtatttctctttatctgccacacctggcaagcagccatgggcgtgtggcagcagtgtctcgaggacgaaaatctgaaggagctggacaagcttcttgctagaaaccttaaaaagctgtggacgggcttcgacgagcgcaccgtcgcctcggacctggccgagatcgtttttccagaacgcctgaggcagacgctgaaaggcgggctgcccgacttcatgagccagagcatgttgcaaaactaccgcactttcattctcgagcgatctgggatgctacccgccacctgcaacgcattcccctccgactttgtcccgctgagctaccgcgagtgtcccccgccgctgtggagccactgctatctcttgcagctggccaactacatcgcctaccactcggacgtgatcgaggacgtgagcggcgaggggcttctcgagtgccactgccgctgcaacctgtgctccccgcaccgctccctggtctgcaacccccagcttctgagcgagacccaggtcatcggtaccttcgagctgcaaggtccgcaggagtccaccgctccgctgaaactcacgccggggttgtggacttccgcgtacctgcgcaaatttgtacccgaggactaccacgcccatgaaataaagttcttcgaggaccaatcgcgcccacagcacgcggatctcacggcctgcgtcatcacccagggcgcgatcctcgcccaattgcacgccatccaaaaatcccgccaagagtttcttctaaaaaagggtagaggggtctacctggacccccagacgggcgaggtgctcaacccgggtctcccccagcatgccgaggaagaagcaggagccgctagtggagcagatggaagaagaatgggacagccaggcagaggaggacgaatgggaggaggagacagaggaggaagaattggaagaggtggaagaggagcaggaaacagagcagcccgtcgccgcaccatccgcgccggcagccccgccggtcacggatacaacctccacagctccggccaagcctcctcgtag

SEQ ID NO: 1097 - DNA, 1473 bp, Adenovirus D24
  MISC_FEATURE (1)..(1473): D24.orf00037 E2A DNA-binding protein
atggccggcggcagtcaggacgtgcgccggttcatggagcgagaggccactccgccccggggccacgggtcggcgcgctatccgccggagcaggagaggagcccctcgccgccaccacctcctctgcccaccaagcgccgaaagtatcagcgggtgggctccgggtcttccgaggaggacgtggtccccgtggacagccctccaaaaaagaagcaagccagaaagaccaagcatgtgaccaaggtagaccccgacgaagagatgccccaggaagatgccgtaatcgtgggagtgggattcagccagcctccggttctgttgaaggaaggcaaggacggaaaacgcatcgtcgagcctgcgacccccggtgtcctgaacgtgcgcaaccccctgagtctgcctctggtctcgtcctgggagaagggcatggataccatgaacgtgctgatggaacgctaccgcgtcgacagcggcctgcgcgatgcttacaagctcatgcccgagcagaccgagatcttccaaaagatgtgccagacctggatgaacgaggaggcccgcggtctgcaactgaccttcaccacccagaaagcatttagcaccgtcatgggtcgcctgttgcaaggttacatcttcagccacagcgggatcgcgcataagaactgggagtgcaccggctgcgccctgtgggatcatggctgctgcgatgtcgagggtcagctcaagtgtctgcatgggacggtgatgatccacaaggaccacgtggtggagatggatgtgaccagcgagaacgggcagcgcgcgttgaaggagcagcccagcaaggccaaggtgacccagaaccgctggggacgtagcgtggtgcaactgaccagccatgacgcgcgctgctgcgtgcatgatgccgggtgcgggaataaccagtttagcgggaagagctgcggcctgtttttcagcgagggggctaaggcccagcaagctttcaagcagatcacggccttcgtcaaggccctctacccgaatatgcagcgcggcgcggggatgatgctgatgcccgtgcactgcgagtgtaaccacaagcctcagagcgtgcccttcctgggccgccagctgtgcaagatgaccccgttcggcctgagcaacgccgaggacctggacaaggatcagatcagcgacaagagcgtgcttgccagtgtgaagtaccccagtctaatggtgttccagtgctgcaaccccgtgtaccgcaactcgcgcgcgcagagcaccggccccaattgtgatttcaagatctccggcccggacatgctgggcgccctgcagatgagccggcgcatgtggagcgagaccttccccgagaccccagtgcccaaactggtgatccccgagttcaagtggcttcccaagtaccagtaccgcaacgtggccctccccagcgcggcgcacaacgacgagcgcgagaaccccttcgacttttaa

SEQ ID NO: 1098 - DNA, 630 bp, Adenovirus D24
  MISC_FEATURE (1)..(630): D24.orf00038 L3 protease
atgagcggctccagcgaacaagagctcgcggccatcgtgcgcgacctgggatgcgggccctactttttgggaacccacgacaagcgcttccctggcttccttgccggcgacaagctggcctgcgccatcgtcaacacggccggccgcgagaccggaggcgtgcactggctcgcctttggctggaatccgcgctcgcgcacctgctacatgttcgacccctttgggttctcggaccgccggctcaagcagatttacagcttcgagtacgaggccatgctgcgccgaagcgcgcttgcctcctcgcccgaccgctgtctcagcctcgagcagtccacccagaccgtgcaggggcccgactccgccgcctgcggacttttttgttgcatgtttttgcatgccttcgtgcactggcccgaccgacccatggacggaaaccccaccatgaacttgctgacgggggtgccaaacggcatgctacaatcgccacaggtgctgcccaccctcaggcgcaaccaggaggagctctaccgcttcctcgcgcgccactccccttactttcgatcccaccgcgccgccatcgaaaacgccaccgcttttgataaaatgaaacaactgcgtgtatctcaataa

SEQ ID NO: 1099 - DNA, 2775 bp, Adenovirus D24; identical to SEQ ID NO: 212
  MISC_FEATURE (1)..(2775): D24.orf00042 L3 hexon

SEQ ID NO: 1100 - DNA, 651 bp, Adenovirus D24
  MISC_FEATURE (1)..(651): D24.orf00043 L3 pVI
atgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaagctcaaagaccagaacttccagcagaaggtggtggacggcctagcctcgggcattaacggggtggtggacatagcaaaccaggccgtgcagcgcgagataaacagccgcctggacccgcggccgcccacggtggtggagatggaagatgcaactcctccgccgcccaagggcgagaagcggccgcggcccgacgcggaggagacgatcctgcaggtggacgagccgccctcgtacgaggaggccgtcaaggccggcatgcccaccacgcgtatcatcgcgccactggccactggtgtaatgaaacccgccacccttgacctgcctccgccacccacgcccgctccaccgaaggcagctccggttgtgcagccccctcctgtggcgaccgccgtgcgccgcgtccccgcccgccgccaggcccagaactggcagagcacgctgcacagtatcgtgggcctgggagtgaaaagtctgaagcgccgccgatgctattga

SEQ ID NO: 1101 - DNA, 117 bp, Adenovirus D24
  MISC_FEATURE (1)..(117): D24.orf00044 L2 pX core protein L2 pX
atgcgcaggcgcctgagtggcggctttctgcccgcgctcatccccataatcgcggcggccatcggcacgatcccgggcatagcttccgttgcgctgcaggcgtcgcagcgccgttga

SEQ ID NO: 1102 - DNA, 1005 bp, Adenovirus D24
  MISC_FEATURE (1)..(1005): D24.orf00046 L2 pV
atgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgtttacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgttgccgctggacgagagcaaccccacgcctagcctgaagcccgtgaccctgcagcaggtgctgccccaagcagtgctgctgccgagccgcggggtcaagcgcgagggcgagaatatgtacccgaccatgcagatcatggtgcccaagcgccggcgcgtggaagaagtgctggacaccgtgaaaatggatgtggagcccgaggtcaaggtgcgccccatcaagcaggtggcgccgggcctgggcgtgcagaccgtggacattcagatccccaccgacatggatgttgacaaaaaaccctcgaccagcatcgaggtgcagaccgacccctggctcccagcctccaccgctgccgtctccacttctaccgccgccacggctaccgagcctcccagaaggcgaagatggggccctgccaaccggctgatgcccaactacgtattgcatccttccattatcccgacgccgggctatcgcggcacccggtactacgccagccgcaggcgcccagccagcaaacgccgccgccgcaccgccacccgccgccgtctggcccccgcccgcgtgcgccgcgtaaccacgcgccggggccgctcgctcgttctgcccaccgtgcgctaccaccccagcatcctttaa

SEQ ID NO: 1103 - DNA, 585 bp, Adenovirus D24
  MISC_FEATURE (1)..(585): D24.orf00047 L2 pVII
atgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttctaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagtacgcccgccatgcgcgccgcccgggctctgctgcgccgcgccagacgcacgggccgccgggccatgatgcgagccgcgcgccgcgccgccactgcaccccccgcaggcaggactcgcagacgagcggccgccgccgctgccgcggccatttctagcatgaccagacccaggcgcggaaacgtgtactgggtgcgcgactccgtcacgggcgtgcgcgtgcccgtgcgcacccgtcctcctcgtccctga

SEQ ID NO: 1104 - DNA, 1545 bp, Adenovirus D24; identical to SEQ ID NO: 182
  MISC_FEATURE (1)..(1545): D24.orf00050 L2 penton

SEQ ID NO: 1105 - DNA, 1605 bp, Adenovirus D24
  MISC_FEATURE (1)..(1605): D24.orf00052 L1 pIIIa
atgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacaaacgtgcagtccaacctggaccggctggtgacggacgtgcgcgaggccgtggcgcagcgcgagcggttcaagaacgagggcctgggctcgttggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccagactactttttccagacgagccggcagggcttgcagacggtgaacctaagccaggctttcaagaatctgcgcgggctgtggggcgtgcaggcgcccgtgggcgaccggtcgacggtgagcagcttgctaacgcccaactcgcggctgctgctgctgctgatcgcgcccttcaccgacagcggcagcgtgaaccgcaactcgtacctgggccacctgctgacgctttaccgcgaggccataggccaggcgcaggtggacgagcagaccttccaggagatcactagcgtgagccgcgcgctgggtcagaacgacaccgacagtctgagagccaccctgaacttcttgctgacaaatagacagcagaagattccggcgcagtacgcgctgtcggccgaggaggagcgcatcctgagatatgtgcagcagagcgtagggcttttcctgatgcaggagggggccacccccagcgccgcgctggacatgaccgcgcgcaacatggaacctagcatgtacgccgccaaccggccgttcatcaataagctgatggactacctgcaccgcgcggctgccatgaactcggactactttactaatgctatactaaacccgcactggctcccgccgccggggttctacacgggcgagtacgacatgcccgaccccaacgatgggttcctgtgggacgacgtggacagcgcggtgttctccccgaccttgcaaaagcgccaggaggcggtacgcacgcccgcgagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccagactggggcgacggatgttttga

SEQ ID NO: 1106 - DNA, 1128 bp, Adenovirus D24
  MISC_FEATURE (1)..(1128): D24.orf00054 L1 52 kDa protein
atgcatcccgtcctgcgccaaatgcgtcccaccccccctccggcgaccaccgcgaccgcggccgtagcaggcgccggcgctgtagccccgccacagcagacagagatggacttggaagagggcgaagggctggcgagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccgttttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccatgtgcgcacgctaatcgcgcgcgaggaggtggccctgggcttgatgcacctgtgggacctggcggaggccatcgtgcagaacccggacagcaagcctctgacggcgcagctgttcctggtggtgcagcacagcagggacaacgaggcgttcagggaggcgctgctaaacatcgccgagcccgagggccgctggctgctggagctgatcaacatcttgcagagcatcgtagtgcaggagcgcagcctgagcctggccgagaaggtggcggctatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcgcgagccggcggcgcgagctgagcgaccgcgagctgatgctgagtctgcgccgggcgctggtagggggcgccgccggcggtgaggagtcctacttcgacatgggggcggacctgcattggcagccgagccggcgcgccttggaggccgcctacggtccagaggacttggatgaggatgaggaagaggaggaggatgcacccgctgcggggtactga

SEQ ID NO: 1107 - DNA, 1854 bp, Adenovirus D24
  MISC_FEATURE (1)..(1854): D24.orf00057 pTP
atggactatttcctgccgctgcgcaacatctggaaccgcgtccgcgagttcccgcgcgcctccaccaccgccgccggcatcacctggatgtcccgctacctctacggctaccaccgcctcatgctcgaggacctggccccgggcgcgccggccacccagcgctggccgctctaccgccagccgccgccgcacttcctagttggataccagtacctcgtgcgcacctgcaacgactatgtcttcgactcgcgcgccttctcgcggctcaggtactcagaggtcgtgcaacccggcctgcagaccgtcaactggtcgctcatggccaactgcacctacaccatcaacaccggggcctaccaccgcttcgtcgacatggacgacttccaggacaccctcacccgcgtgcaacaggccatcctcgccgagcgcgtcgtcgccgacctggcgctcgtgcagccgctcaggggcgtcggggtcacccgcatggaagactccgcctccgccagtgatgacattgagaggctcatgcatgactactacaagaacctgagccggtgtcagggccaggcctggggcatggccgagcggcttcgcatccagcaagcgggacccaaggacctggtcctcctcgccaccatccgccgccttaaaaacgcctacttcaattacatcatcagcaaccgcaattctaacagcgtccacagggctgctacgtgtttgagcttaccttgcgactgcgattggctagacgctttcctcgaaagattctccgatccggtcgatctcgacgcgctcacgtcccctacaccgcaattgataagatgcatcgtcagcgccctctcgctgcccaacggggacccgccccattaccgggagatgaccggcggcgtcttcacgctgcgtcctcgcgaacggggtcgcgccgtcaccgaaaccatgcgtcgccgccgcggggagatgatcgagcgcttcgtcgaccgtctcccggtgcgtcgccgtcgtcgtcgggccccgccaccaccaccgcccccagaggaagaaatagaagaagaggtcgtcatggaagaagaggaagaggaggaggcccccggggatttcgagcgcgaggtgcgcgccaccatcgccgaactcatcaggctcctggaggacgagctcacggtctcggcccgcaacgcccagtttttcaacttcgctgtggatttctacgaggccatggaaaggctggaggccatcggcgacatcagcgagatgcccctgcgccgctggatcatgtacttcttcgtcaccgagcacatcgccaccaccctaaactacctcttccagcgcctgcgcaactacgccgtcttcacgcggcacgtggagctcaacctcgcgcaggtggtcatgcgcgcgcgcgacgccgacggggacgtggtctacagccgcgtctggaatgagagcggcctgggcgccttctcgcagctcatgggtcgcatctccaatgacctcgccgccaccgtggagcgcgcgggccgcggcgatctccaggaggaggagatcgagcagttcatgtccgagatcgcctaccaggacaactcgggcgacgtgcaagagatcctgcgtcaggccgccgtcaatgacgccgagattgattctgttgaactgtctttcaggttcaaagtcacggggccggtggtcttcacgcagaggcggcagatccaggatgtcaaccgccgcgtcgtcgcgcacgccagcgctctcagggcgcagcaccgggacctgcccgagcgccacgccgacgtgcctctgccgcccctgcccgcggggccggaaccgccgctgccgccgggagcgcgtccgcgacaccgcttctaa

SEQ ID NO: 1108 - DNA, 3276 bp, Adenovirus D24
  MISC_FEATURE (1)..(3276): D24.orf00058 E2B DNA polymerase
atgcaatgcgtggacacagccaccaactcacccgtggagatcaagtaccatctgcatctcaagcacgccctcacccgcctctacgaggtcaacctcagaaccctgcccccggacctggatctccgcgacaccatggacagctcccaactgcgcgccctcgtcttcgctctccgcccccgccgcgccgagatctggacctggctcccgcgcgggctcgtcagcctctccgtcctcgaggagccccagggtgagtcccacgcaggcgaacatgaaaaccaccagccagggccgccactcctgaagttcctcctcaagggacgcgctgtgtatctcgtggatgaggtacagcccgtgcagcgctgcgagtactgcggacgcttttacaagcatcagcacgagtgctcggttcgccggcgggatttctactttcatcacatcaacagccactcgtccaactggtggcaggaaatccagttcttcccaatcggctctcatcctcgcacggagcggctctttgtcacctacgatgtagaaacctacacctggatggggtccttcggcaagcagctcgtcccctttatgctggttatgaaattctcgggggacccagagctggtcgccctcgctcgcgatctagccgtgcgcttacgctgggatcgctgggagcgggacccccttactttctactgcgtcaccccagaaaagatggccgtgggccagcagttccgcctctttcgcgacgagctccagacccttatggcccgcgagctctgggcttcattcatgcaagccaacccacatctccaggagtgggcgctcgagcagcacggactgcattgccccgaggacctcacctacgaggagctcaaaaagctgccgcacattaaaggccgcccgcgattcatggaactctacatcgtcgggcacaacatcaacggcttcgacgagatcgtcctcgccgcccaggtcatcaacaaccgagcctccgtcccgggccctttccgcatcacccgcaatttcatgccgcgggcaggcaagattctcttcaatgacgtcactttcgctctgcctaaccccctctcgaagaagcgcaccgatttcgagctctgggagcacggcggctgcgacgactcggatttcaagtaccagttcttgaaagtcatggtcagggataccttcgccctgacgcacacctcgctccgcaaggccgctcaagcttacgccctccccgtggagaagggctgctgtccctacaaggccgtgaaccatttctacatgctgggctcttaccgtgcggacgatcgaggattcccgctccgggagtactggaaggatgacgaggagtacgccctcaaccgcgagctatgggagaagaaaggagaggcgggttatgacatcatccgcgaaacgctggactactgcgccatggacgtcctcgtcaccgccgagctcgtcgccaagctgcaagactcctacgcgcacttcatccgcgactcggttcgtctgcctcatgcccactttaacatcttccaacggcccaccatctcctccaactcgcatgccatctttcgccagatcgtcttccgcgccgagcagccccagcgcaccaatctcggccccgccttcttggccccctcgcacgagttgtatgactacgtgcgcgccagcatccgcggggggcgctgttatcccacctacatcggcatcctctcggagcccatctatgtctacgacatctgcggcatgtacgcctccgccctgacgcatcccatgccctggggtccgcccctcaacccctacgagcgagcgctggccgcccgcgagtggcagatggccttggatgatgcatcctcaaaaatcgattattttgacaaggaactctgtccgggcatcttcaccatcgatgcggacccccctgacgagcatctgcttgatgtgctgcccccgttctgctcgcgcaagggcggacgcctctgctggaccaacgagcccctgcgcggcgaggtggccaccagcgtggatctggtcaccctgcataaccgcggctggcgcgtcaggatcgtgcccgacgagcgcaccaccgtcttccccgaatggaagtgcgtcgcgcgcgagtatgtccagctcaacatcgcggccaaggagcgagccgaccgtgacaaaaatcagaccatgagatccatcgccaagcttctctccaacgccctctatggctccttcgccaccaagcttgacaataaaaaaatagtcttttctgaccagatggatgaaagtctcctaaaaagcattgcggcagggcaagccaacatcaaatcctcctcgtttctagaaactgacaacctgagtgccgaggtcatgcccgctctcgaaagggaatacctaccccaacagctggcgctcgtggacagcgacgcggaagagagtgaggacgagcacagacccgcccccttttatacccccccgtcggggaccccgggtcacgtggcctacacctacaagccaatcaccttcttggatgcggaggagggggacatgtgtctgcataccgtggaaaaggtggaccccctggtggacaacgaccgctacccctcgcacgtggcctcctttgtcttggcgtggacgcgcgccttcgtctcagagtggtccgagtttctctacgaggaggaccgcgggacgcccctgcaggacaggcccatcaagtccgtctacggggacacagacagcctgtttgtcaccgagcgcggacacagactcatggagacgcgaggtaagaagcgcatcaaaaagaacgggggaaaactggtttttgaccccgagcagcccgagctcacctggctggtcgagtgcgagaccgtctgcgcccactgcggagcggatgctttcgcccccgagtccgtctttctcgcacccaagctctacgccctgcaatccctcctctgtcccgcctgcgggcgctcttccaagggcaagctccgcgccaagggccacgccgccgaggccctcaactacgagctcatggtcaactgctatctcgccgacgcgcagggcgaagaccgtgcccgtttcagcaccagcaggatgagtctcaagcgcacccttgcaagcgcacagcccggggcccaccccttcaccgtgacggagaccacgctcacgcggacactgagaccctggaaggacatgacgctggcagcgctggacgcccatcgtctcgtgccctacagtcgcagtcgtcccaacccccgaaacgaggaagtctgctggatcgagatgccgtag

SEQ ID NO: 1109 - DNA, 1047 bp, Adenovirus D24
  MISC_FEATURE (1)..(1047): D24.orf00059 pIVa2 protein
atgcccatggccgacgggctcaagcccctgaaaaactttgcttccctgcaagagctgctctcgctgggcggggaccgcctcctcggcgagctcgtccgggaaaacctccaagtcagagacatgctcaacgaggtggcccccctcctccgggacgacggcagctgcatgtccttgaactaccacctgcaacccgtcatcggggtcatctacggcccgaccgggtgcggcaagtcccagctgttgagaaacctgctctcctcgcagctcatcacccccgccccggaaaccgtttttttcatcgccccgcaggtggacatgatccccccctccgagatgaaagcctgggagatgcaaatatgtgaggggaacttcgccccggggcccgagggaaccattgtcccccaatctggcaccctccgccccaaattcattaaaatgtcttatgatgatctcacccaggagcataattacgatgtctctgaccccagaaacgtctttgccaaagccgcagcccacgggcccatcgccatcatcatggatgagtgcatggaaaacctgggtgggcacaagggcgtctccaaattctttcacgcattcccttccaagttgcatgacaagttccccaagtgcacgggctacaccgttctggtggtcctgcacaacatgaaccccaggcgggatctgggtggcaacatcgccaacctcaagatccaggccaaactccacatcatctccccccgcatgcatccctcccagctcaaccgcttcgccaacacctacaccaaggggctccccgtggccatcagtctcctcctcaaggacatcatccagcaccacgcccagcgcccctgctatgactggatcatctacaacacgaccccagagcacgaggccatgcagtggtgctacctccacccccgggacgggctcatgcccatgtacctcaacatccaatcccacctctaccgggtcctggaaaaaatccaccgcactctcaatgatcgggagaggtggaccagggcctaccgcgcgcgaaaaaataaataa

SEQ ID NO: 1110 - DNA, 405 bp, Adenovirus D24
  MISC_FEATURE (1)..(405): D24.orf00062 IX pIX
atgaacgggactggcggggccttcgaaggggggctttttagcccttatttgacaacccgcctgccgggatgggccggagttcgtcagaatgtgatgggatcgacggtggacgggcgtccagtgcttccagcaaattcctcgaccatgacctacgcgaccgtggggaactcgtcgctcgacagcaccgccgcagccgcggcagccgcagccgccatgacagcgacgagactggcttcgagctacatgcccagcagcagcagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatga

SEQ ID NO: 1111 - DNA, 1488 bp, Adenovirus D24
  MISC_FEATURE (1)..(1488): D24.orf00063 E1B 55 kDa protein
atggagccagaacacccaactgagcaggggctacattctggacttcgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcagggtgctgacatccatggccaggggagtgaagagggagaggagcgatgggggcaataccgggatgatgaccgagctgacggccagcctgatgaatcgcaagcgtccagagcgcattacctggcacgagctacagatggagtgtagggatgaggtgggcctgatgcaggataaatatggcctggagcagataaaaacccactggttgaacccagatgaggattgggaggaggccattaagaaatatgccaagatagccctgcgcccagattgcaagtacagggtgaccaagacggtgaatatcagacatgcctgctacatctcggggaacggggcagaggtggtcatcgataccctggacaaggccgccttcaggtgttgcatgatgggaatgagagccggagtgatgaatatgaattccatgattttcatgaacatgaagttcaatggagagaagtttaatggggtgatgttcatggccaacagtcacatgaccctgcacggctgcagtttcttcggcttcaacaatatgtgcgcagaggtctggggcgctgctaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacattgctcttccctggagacgggctgcttctgcctggtgaagggcacagcctctctgaagcataatatggtgaagggctgcacggatgagcgcatgtacaacatgctgacatgcgactcgggggtctgccatatcctgaagaacatccatgtgacctcccacccccggaagaagtggccagtgtttgagaataacctactgatcaagtgccacatgcacctgggcgccagaaggggcaccttccagccgtaccagtgcaactttagccagaccaagctgctgctggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcaaccagtggccctggatgtgaccgaggagctgaggcccgaccacctggtgatggcttgtaccgggaccgagttcagctccagtggggaggacacagattag

SEQ ID NO: 1112 - DNA, 207 bp, Adenovirus D24
  MISC_FEATURE (1)..(207): D24.orf00065 E1A 14.8 kDa protein
gtgtcagaggatgagtcatcaccctcagaagaagaccacccgtgtccccctgagctgtcaggcgaaacgcccctgcaagtgcacagacccaccccagtcagacccagtggcgagaggcgagcagctgttgaaaaaattgaggacttgttacatgacatgggtggggatgaacctttggacctgagcttgaaacgccccaggaactag

SEQ ID NO: 1113 - DNA, 549 bp, Adenovirus D24
  MISC_FEATURE (1)..(549): D24.orf00068 E1A 28 kDa protein
gtgcctattgacatggccgcattattgctggaggattatgtgagtacaatattggaggacgaactgcatccatctccatttgagctgggacctacacttcaggacctatatgatttggaggtagatgcccatgatgacgacccgaacgaagaggctgtgaatttaatatttccagaatctctgattcttcaggctgacatagccagcgaagctgtacctacaccacttcatacaccgactctgtcacccatacctgaattggaagaggaggacgagctagacctccgatgttatgaggaaggttttcctcccagcgattcagaggacgaacagggtgagcagagcatggctctaatctcaaaatatgcttgtgtggttgtggaagagcattttgtgttggacaatcctgaggtgcccgggcaaggctgtagatcctgccagtaccaccgggataagaccggagacacgaacgcctcctgcgctctgtgttacatgaaaaagaacttcagctttatttacagtaagtggagtgaatgtgagagagactga

SEQ ID NO: 1114 - DNA, 378 bp, Adenovirus D25
  MISC_FEATURE (1)..(378): D25.orf00002 E4 ORF1 protein
atggctgaatctctgtatgctttcatagatagccctggagggattgctcccgtccaggaagggactagcaatagatatacctttttttgcccagaatctttccacattcctccgcatggggtggttttggttcacttgagagtgagcgtgctgattcctaatggctaccaaggcagatttatggccttgaatgactaccattccaggggcatactaacccagtccgatgtgatctttgctgggagaagacaggagctaactgtgctgctctttaaccacacggatcgatttttgtatgtccgagagggccacccagtgggcactttgctgctggagagagtgatttttccttcagtgagactggcaactctggtttag

SEQ ID NO: 1115 - DNA, 393 bp, Adenovirus D25
  MISC_FEATURE (1)..(393): D25.orf00003 E4 ORF2 protein
atgcttgagcgacacgctgtcagctaccacattgtggttcctggggtcctagtgacttatttagaggacttttctattactcaaatgattaaagaaaaactacctcgctttatcactcacctattggaaggcatcaccggtgacacaaagagagcttattccagcatgcagtttttgggtgctagctttggagcattaaagtactcactcacgcttgccagtcccacgcttagccctggctctgaattgtcagctgtagtggctgaggacttgagtgactttttgcagctgacgctgagacgtgagctgagggcagagggcagaacctcattgaatcttgttgttttgaacacgctgcaggtggtggagcagcaggatctgtttctaatatga

SEQ ID NO: 1116 - DNA, 354 bp, Adenovirus D25
  MISC_FEATURE (1)..(354): D25.orf00005 E4 ORF3 protein
atgaaggtctgcctgattatgaaagtggagggggcgctgtgggaacttttccacatgtgcggagtggacttacaccaacaatttgtagaaataatccaaggctggaaaaatgagaattacctggggatggtgaatgagtgtaacctgatgattgatgaaatcgatggaggtccagcctttaatgtgattcttatgctggatgtacgcgtagagccactgctcgaagccacagtcgagcaccttgaaaatagagtgggttttgacctggctgtctgtttccaccagcacagcggcggggaacgctgtcacctgcgtgacttgcactttatcgtccttcgagaccgcttggaataa

SEQ ID NO: 1117 - DNA, 363 bp, Adenovirus D25
  MISC_FEATURE (1)..(363): D25.orf00007 E4 ORF4 protein
atggttcttccagttcttcccccacctcctcttcatgatagatcaggatgcattaactggattgggatggcctacaatgtcctggctgatgttttaaggggaatccgcatcgacgggacttttgtttcatcagatgcacaggagctgctggagaacctgcgggaatggctgtacttcagttggatgactgagcgtcagcagcggaaggacagcaggaggaaaggtatctgctgttcccgagccactttctgctggcagaagtacgacaaggtacgcaagagaatccatttcaatgtccaccgaggaacagtcgagctcgctccgccatcatccttaccgcagggcccgtttaccacgatgtga

SEQ ID NO: 1118 - DNA, 663 bp, Adenovirus D25
  MISC_FEATURE (1)..(663): D25.orf00010 E4 34.1 K E4 ORF6 34.1 kDa protein
atgatcctgaccccagaggaaataaaaattttaaaaagatgtatgtcagtgtgcctgtgccccgctaccctggacttggtgagagctcagatggtgagcgggtacgagcgctggatcctgcattgccactgttcatccccgggctccctgcagtgtcgggcgggaggcaccctgctggccgtgtggttcaggagagtcatttacgggtgcatgttcaaccagcgattcccatggtaccgccagattgtgaacagaaacatgcccaaagagatcatgtatatgggcagtgtgttcatgaggggcaggcacctgatatactgccgcatctggtacgatggtcacgtgggttcaataatccccaacatgagctttggctggagcgccctgaattatgggctgctgaataacatggtgattatgtgctgcacttactgtgagaacatggcagagatcaggatgcggtgctgtgcccgacgcaccaggagactgatgctgaaggctgtggggatcatagtcagagagacttgcgatcccgatcccatctgcagcagccgcaccgagccccggcggcagagactgttgagggcgctgatggagaggcacagacccatcctgttttccgagtatgaatctgtgcgttcttctcattccaccagactgtga

SEQ ID NO: 1119 - DNA, 246 bp, Adenovirus D25
  MISC_FEATURE (1)..(246): D25.orf00011 E4 ORF6/7 protein
gtgaccttggactgtgaggcccgcttggatgacttttcagaggacggcttcatctcaatcaccgacccccgtttggctcgccaggaaactgtgtggattatagaccccaagtcaagttcccgcactaatcagaacatttccctatttaaggccacccgtgctgaaagaaccgtgtacactgtgaaatgggctggtggtgggagactaactacccgtgctggtgtaaaaatcaataaagatacatga

SEQ ID NO: 1120 - DNA, 1098 bp, Adenovirus D25; identical to SEQ ID NO: 153
  MISC_FEATURE (1)..(1098): D25.orf00012 L5 fiber

SEQ ID NO: 1121 - DNA, 150 bp, Adenovirus D25
  MISC_FEATURE (1)..(150): D25.orf00013 U protein
atgaaaattgtggaccaggaatttgacatccctttcaaggtgtggagaaagtttgccgcccgccggggacttgagtaccagagctgggaggagggtactgaggtgttgctgaacaactacaccagagacatactttcagatttcaagtaa

SEQ ID NO: 1122 - DNA, 390 bp, Adenovirus D25
  MISC_FEATURE (1)..(390): D25.orf00014 E3 14.5 kDa protein
atgactgaccacttggacctcgagatggacggccaggcctccgagcagcgcaccctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcatcaaccccatagtcatcacccagcagtcgggcgaggccagcggctgcatccactgctcctgcgaaagccccgagtgcatctactccctactcaagaccctttgcggactccgcgaccttctccccatgaactga

SEQ ID NO: 1123 - DNA, 276 bp, Adenovirus D25
  MISC_FEATURE (1)..(276): D25.orf00016 E3 RID-beta
atggatatgccttcctattacttggtgattgttggggtagtcatggtctgctcctgcactttctttgccatcatgatctacccctgttttgatctcggctggaattctgttgaggcattcacatacacactagaaagcagttcactagcctccacgccaccacccacaccgcctccccgcagaaatcagtttcccatgattcagtacttagaagagccccctccccgacccccttccactgttagctactttcacataaccggcggcgatgactga

SEQ ID NO: 1124 - DNA, 276 bp, Adenovirus D25
  MISC_FEATURE (1)..(276): D25.orf00017 E3 RID-alpha
atgattcctaggttcttcctatttaacatcctcttctgtctcttcaacatctgcgctgccttcgcggccgtctcgcacgcctcacccgactgtctcgggcccttccccacctacctcctctttgccctgctcacctgcacctgcgtctgcagcattgtctgcctggtcatcaccttcctgcagctcatcgactggtgctgcgcgcgctacaattacctgcatcacagtcccgaatacagggacgagaacgtagccagaatcttaaggctcatatga

SEQ ID NO: 1125 - DNA, 891 bp, Adenovirus D25
  MISC_FEATURE (1)..(891): D25.orf00019 E3 CR1-gamma
atgaaggctttcacagcttgcgttctgattagcatagtcacattagtatcagctgattacaaacaagttcaagttagcagaggaggaaatattacattagatggaccattcgataatactacatggacaagatatcataatgatggacataaaaatggttggatgaaaatttgcacatggactggagcaacatataaatgtcacaataatggaagcattactatttttgctttcaacattacatccggagtttacaaagcagaagggtataaaaaagaagttagaacattttcatctagaaatcaaaaacatacaattgaagattctggagattatgaacaacaaaaaatatatctatataatctaacaataattgaaccgccaactactaaagcacccaccacagttagaacaaccacgcagacaactactagggaaacaacacagcctactactgtacccactacacatccaaccaccacagtcagtacaactactgacaccacaactcacactacacatctagacactacagtgcagaatactactttattgattgggtttttactaagaggaaatgaaagtactactgatcagacagaggctacctcaagtgccttcagcagcactgcaaatttaacttcgcttgcttcggtaaatgagacgatcgtgccgatgatgtatggccaacattacccaggtttggatatacaaattactttcctgattgtctgtggggtctttatcctcgctgtccttctctactttgtctgctgcaaggccagagaaaaatctaggcggcccatctacaggccagtaatcggggaacctcagccactccaagtggatggaggcttaaggaatcttctcttctcttttacagtatggtga

SEQ ID NO: 1126 - DNA, 1284 bp, Adenovirus D25
  MISC_FEATURE (1)..(1284): D25.orf00020 E3 CR1-beta
atgaatacagtgatccgtatcgtgctgctctctcttcttgtagcttttagtcaggcaggatttcatactatcaatgctacatggtgggctaatataactttagtggggccctcagatacgccagtcacctggtatgataaacagggaatgcagttctgtgatggaaatacagttaagaatcctcaaataagacatgagtgtaatgagcaaaaccttacactaattcatgtgaacaaaacccatgaaaggacatacatgggttataatagacagagtactcataaggaagactataaagtcatagttataccgcctcctcctgctactgtaaagccacagtcaggtccagagtatgtatatgttaatatgggagagaacaaaaccttagttggacctccaggaataccagttacttggtatgacggagaaggaaataaattctgcgatggagaaaaagttgaacatgcagaatttaatcatacatgtgatgtgcaaaatcttacactgttgtttataaatcttacacatgatggggcttatcttggctataatcaccagggaactaaaagaacttggtatgaggttgtagtgacagatggttttccaaaatcaggggagatgaaaatcgaagatcagagtagacaaacagaacaaaaacaaactgggcaaaaacaaaatgagcataaacagggtgggcagaaacaggaggggcaaaaagagacaagtcaaaagaaagctagtgacaaacagaaggcgacacacaggaggccatcaaaactaaagccgcacacacctgaagcaaaactgattacagtttgtagtgggtctaacttaacattacttgggccagatggaaaggtcacttggtatgatgatgatttaaaaagaccatgcgagcctgggtataagttagagtgtaagtgtgacaatcaaaacctaacactaatcaatgtaactaaactttatgagggagtttactatggtactaatgacagaggcaacagcaaaagatacagagtaaaattaaacactactaattctcaaagtgtgaaaattcagccgtacaacagacctactactcctgatcagaaacacagatttgaattgcaaattgattctaatcaagacaatgacaaaattccatcaaccactgtggcaatcgtggtgggagtgattgcgggcttcataactataatcattgtcattctgtgctacatctgctgccgcaagcgtcccagggcatacaatcatatggtagacccactactcagcttctcttactga

SEQ ID NO: 1127 - DNA, 255 bp, Adenovirus D25
  MISC_FEATURE (1)..(255): D25.orf00022 E3 gp 17.5 kDa protein
atgcagtgtgatatcacacatgacttcaaaaatgaatttgaaaccgaaagtgtgatttccattgctaccatggacagtgaccgtgtagttctgctcatctcctggttcccaatcgcccacccatgcatttcccatggtcttattcttgaatgtgatgttgagaggacatgtatgctcgcatttgatgactactgtgcatatcacactcctctcattgcctgtggtgatgttacatcgtggctgttcgtggcatga

SEQ ID NO: 1128 - DNA, 192 bp, Adenovirus D25
  MISC_FEATURE (1)..(192): D25.orf00023 E3 gp 17.5 kDa protein
atgtgtgatatcacactgcatgtggctagacttcatggcttgtggccccctaccaaggagaacatggttgggttttctttggcttttgtgatcatggcctgtgcaatgtcaggtctgctggtaggggctataatatggttcctgaggcacaagcccaggtatggaaatctggaaaaggaaaaattgctataa

SEQ ID NO: 1129 - DNA, 594 bp, Adenovirus D25
  MISC_FEATURE (1)..(594): D25.orf00024 E3 CR1-alpha
atgagaatttttgctgtactctttgtggtgagtttaataaaagctaaactcttgcaatactctggaccttgtcgtcgtcaactcaacaagaccttcaacctcaccaaccagactgaggtaaaactcaactgcagaccaggggacaaatacatcctctggctctttgagaacacttccttcgcagcctccaacacctgtgccaacgacggtattgaaatacccaacaaccttaccagtggactgacttacaccaccagaaagactaagctagtgctctacaatccttttgtagagggaacctaccactgccagagcggaccttgctaccacactttcactttggtgaacgttaccggcagcagcacagccgctccagaaacatctaaccttctttttgatactaacactcctaaaaccggaggtgagctctgggttccctctctgacagaggggggtaaacatattgaagcggttgggtatttgattttaggggtggtcctgggtgggtgcatagcggtgctgtattaccttccttgctggatcgaaatcaaaatctttatctgctgggtcagacattgttgggaggaaccatga

SEQ ID NO: 1130 - DNA, 321 bp, Adenovirus D25
  MISC_FEATURE (1)..(321): D25.orf00025 E3 12.2 kDa protein
atgtcctatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctgatcaggttcttcacccagcaacccttcctggtcgagcgggaccggggcgccaccacctacaccgtctactgcatctgtcctaccccgaagttgcatgagaatttttgctgtactctttgtggtgagtttaataaaagctaa

SEQ ID NO: 1131 - DNA, 684 bp, Adenovirus D25
  MISC_FEATURE (1)..(684): D25.orf00026 L4 pVIII
atgagcaaggagattcccaccccttacatgtggagctatcagccccagatgggcctggccgcgggcgcctcccaggactactccacccgcatgaactggctcagtgccggcccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctaaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggttgacggctacgactga

SEQ ID NO: 1132 - DNA, 219 bp, Adenovirus D25; identical to SEQ ID NO: 912
  MISC_FEATURE (1)..(219): D25.orf00027 L4 20 kDa protein

SEQ ID NO: 1133 - DNA, 186 bp, Adenovirus D25; identical to SEQ ID NO: 949
  MISC_FEATURE (1)..(186): D25.orf00028 L4 22 kDa protein

SEQ ID NO: 1134 - DNA, 2196 bp, Adenovirus D25
  MISC_FEATURE (1)..(2196): D25.orf00030 L4 100 kDa protein
atggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaaccttttctcgccgcgcgtgccccccaaacgccagcccaacggcacctgcgagcccaacccgcgtctcaacttctatcccgtctttgcggtccccgaggcccttgccacctatcacatctttttcaagaaccaaaagatcccagtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgttgagctcacccacttcgcctaccccgccgtcaacctcccgcccaaggtcatgcgtcgcatcatggatcagctcatcatgccccacatcgaggccctcgatgagacccaagagcagcgcccagaggacgcccggcctgtggtcagcgacgagcagctcgcgcgctggctcgggacccgcgacctccagaccctggagcagcggcgcaagctgatgctggccgtggtcctggtcaccctcgagctcgaatgcatgcgccgcttcttcagcgaccccgagaccctgcgcaaggtcgaggagaccctgcactacactttcaggcacggcttcgtcaggcaggcctgcaagatctccaacgtggagctgaccaacctggtctcctgcctggggatcctgcatgagaaccgccttgggcagaccgtgctccactctaccctgaagggcgaggcgcggcgggactatgtccgcgactgcatctttctatttctctgccacacatggcaagcagccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgaggcagacgctgaaaggcgggctgcccgactttatgagccagagcatgttgcaaaactaccgcactttcattctcgagcgatcggggatcctacccgccacctgcaacgccttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctcctaagcgagacccaggtcatcggtaccttcgagctgcaaggtccggagaagtccaccgctccgctgaaactcacgccggggttgtggacttccgcgtacctgcgcaaatttgtacccgaggactaccacgcccacgagataaagttcttcgaggaccaatcgcgccctcagcacgcggatctcacggcctgcgtcatcacccagggcgcgatcctcgcccaattgcacgccatccaaaaatcccgccaagagtttcttctgaaaaagggtagaggggtctaccttgacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtag

SEQ ID NO: 1135 - DNA, 1470 bp, Adenovirus D25
  MISC_FEATURE (1)..(1470): D25.orf00032 E2A DNA-binding protein
atggccggcggcagtcaggacgtgcgccggttcatggaccgagaggccactccgccccggggccacggttcagcgcgctatccgccggagcaggagaggagcccctcgccgccacctcctctgcccaccaagcgccgaaagtatcagcgggtgggctccgggtcttccgaggaggacgtggtccccgtggacagccctccaaaaaagaagcaagccagaaagaccaagcatgtgaccaaggtagaccccgacgaagagatgccccaggaagaagccgtgatcgtgggagtgggattcagccagccgccggttctgttgaaggaaggcaaggacggaaaacgcatcgtcgagcccgcgacccccggtgtcctgaacgtgcgcaaccccctgagtctgcctctggtctcgtcctgggagaagggcatggataccatgaacgtgctgatggaacgctaccgcgtcgacagcggcctgcgcgatgcttacaagctcatgcccgaacagaccgagatcttccaaaagatgtgccagacctggatgaacgaggaggcccgcggtctgcaactgaccttcaccacccagaaagcatttagcaccatcatgggccgcatgttgcaaggttacatcttcagccacagcgggattgcgcacaagaactgggagtgcaccggctgcgccctgtgggatcacggctgcaccgaggtggaaggccagctcaagtgtctgcatggaacggtgatgatccacaaggatcacgtggtggagatggatgtgaccagcgagaacgggcagcgcgcgttgaaggagcagcccagcaaggccaaggtgacccagaaccgctggggacggagcgtggtgcaactgaccagccatgacgcgcgctgctgcgtgcatgatgccggttgcgggaataaccagttcagcgggaagagctgcgggctgtttttcagcgagggggccaaggcccagcaagctttcaagcagatctcggcatttgtcaaggccctctacccgaatatgcagcgcggcgcggggatgatgctaatgcccgttcactgcgagtgtaaccacaagcctcagagcgtgcccttcttgggccgccagctgtgcaagatgaccccgttcggcctgagcaacgccgaggacctggacaaggatcagatcagcgacaagagcgtgctggccagtgtgaagcaccccagtctgatggtgttccagtgctgcaaccccgtgtaccgcaactcgcgcgcgcagagcaccggtcccaactgcgatttcaagatatccgcgcctgacatattgggcgccctgcagatgagccggcgcatgtggagcgagaccttccccgagattccggttcccaaactggtgatccccgagttcaagtggcagcccaagttccagtaccgcaacgtggccctccccagcgcggcgcacaacgacgagcgcgagaaccccttcgacttttaa

SEQ ID NO: 1136 - DNA, 630 bp, Adenovirus D25
  MISC_FEATURE (1)..(630): D25.orf00033 L3 23.6 kDa protease
atgagcggctccagcgaacgagagctcgcggccatcgtgcgcgacctgggctgcgggccctactttttgggcacccacgacaagcgcttcccgggcttcctcgccggcgacaagctggcctgtgccatcgtcaacacggccggccgcgagaccggaggcgtgcactggctcgccttcggctggaacccgcgctcgcgcacctgctacatgttcgacccatttgggttctcggaccgccggctcaagcagatttacagcttcgagtacgaggctatgctgcgccgcagtgccctggcttcctcgcccgaccgctgtctcagcctcgaacagtccacccagaccgtgcaggggcccgactccgccgcctgcggacttttctgttgcatgttcttgcatgccttcgtgcactggcccgaccgacccatggacggaaaccccaccatgaacttgcttacgggggtgcccaacggcatgctacaatcgccacaggtgctgcccaccctccggcgaaaccaggaggaactctaccgcttcctcgcgcgccactccccttactttcgatcccaccgcgccgccatcgaacacgccaccgcttttgacaaaatgaaacaactgcgtgtatctcaataa

SEQ ID NO: 1137 - DNA, 2838 bp, Adenovirus D25; identical to SEQ ID NO: 213
  MISC_FEATURE (1)..(2838): D25.orf00036 L3 hexon

SEQ ID NO: 1138 - DNA, 651 bp, Adenovirus D25
  MISC_FEATURE (1)..(651): D25.orf00037 L3 pVI
atgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaagctcaaagaccagaacttccagcagaaggtggtggacggcctggcctcgggcattaacggggtggtggacatcgcgaaccaggccgtgcagcgcgagataaacagccgcctggacccgcgaccgcccacggtggtggagatggaagatgcaactcctccgccgcccaaaggcgagaagcggccgcggcccgacgcggaggagacgatcctgcaggtggacgagccgccctcgtacgaggaggccgtgaaggccggcatgcccaccacgcgcatcatcgcgccgctggccacgggtgtaatgaaacccgccacccttgacctgcctccaccacccacgcccgctccaccgaaggcagctccggtcgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattga

SEQ ID NO: 1139 - DNA, 156 bp, Adenovirus D25
  MISC_FEATURE (1)..(156): D25.orf00038 L2 pX core protein L2 pX
atggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttga

SEQ ID NO: 1140 - DNA, 1005 bp, Adenovirus D25
  MISC_FEATURE (1)..(1005): D25.orf00040 L2 pV
atgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgccaaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcagaccgacccctggctcccagcctccaccgccaccgcctccacttctaccgccgctacggccaccgagcctcccaggaggcgaagatggggcgccgccagccggctgatgcccaactacgtgttgcatccttccatcatcccgacgccgggctaccgcggcacccggtactacgccagccgcaggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaa

SEQ ID NO: 1141 - DNA, 525 bp, Adenovirus D25
  MISC_FEATURE (1)..(525): D25.orf00042 L2 pVII
atgtacggaggagccaagaaacgctcccagcagcaccccgtccgcgtccgcggccactttcgcgctccctggggagcttacaagcgggggcggactcccgctgccgccgtgcgcaccaccgtcgacgacgtcatcgactcggtggtcgccgacgcgcgcaactacacccccgccccctccaccgtggacgcggtcatcgacagcgtggtggccgacgcgcgcgactatgccagacgcaagagccggcggcgacggatcgccaggcgccacaggagcacgcccgccatgcgcgccgcccgagctctgctgcgccgcgccagacgcacgggccgccgggccatgatgcgagccgcgcgccgcgccgccactgcaccccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctga

SEQ ID NO: 1142 - DNA, 1512 bp, Adenovirus D25; identical to SEQ ID NO: 183
  MISC_FEATURE (1)..(1512): D25.orf00044 L2 penton

SEQ ID NO: 1143 - DNA, 1596 bp, Adenovirus D25
  MISC_FEATURE (1)..(1596): D25.orf00047 L1 pIIIa
atgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggttccccagagcgaggtgtaccagtcgggcccggactactttttccagacgagccggcagggcctgcagacggtgaacctgagccaggctttcaagaacctgcgcgggctgtggggcgtgcaggcgcccgtgggcgaccggtcgacggtgagcagcttgctgacgcccaactcgcgactgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagccgcgcgctggggcagaacgacaccgacagtctgagggccaccctgaactttttgctgaccaatagacagcagaagatcccggcgcagtacgcactgtcggccgaggaggaaaggatcctgagatatgtgcagcagagcgtagggctatttctgatgcaggagggtgccacccccagtgccgcgctggacatgaccgcgcgcaacatggaacctagcatgtacgctgccaaccggccgttcatcaataagctgatggactacctgcaccgcgcggcggccatgaacacggactactttaccaacgccatattgaacccgcactggctcccgccgccggggttctacacgggcgagtacgacatgcccgaccccaacgacgggttcctgtgggacgacgtggacagcgcggtgttctcgccggcctttcaaaagcgccaggaggcgccgccgagcgagggcgcggtgggccgcagcccatttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccaaactggggcggcggatgttttga

SEQ ID NO: 1144 - DNA, 957 bp, Adenovirus D25
  MISC_FEATURE (1)..(957): D25.orf00049 L1 52 kDa protein
gtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgatcaacatcttgcagagcatcgtagtgcaggagcgcagcttgagcctggccgagaaggtggcggcgatcaactactcggtgttgagcctgggcaagttttacgcgcgcaagatttacaagacgccgtacgtgcccatagacaaggaggtgaagatagacagcttttacatgcgcatggcgctcaaggtgctgacgctgagcgacgaccttggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactga

SEQ ID NO: 1145 - DNA, 363 bp, Adenovirus D25
  MISC_FEATURE (1)..(363): D25.orf00050 L1 52 kDa protein
atgtcgctccggggacggcgcccccagtcttgccagcccttcgccctcttccaagtccatctctgtctgtggtggctggctagcgccggcgcctgctacggccgcggtcgcggtggtcgccgggggggtgggacgcatttggcgcaggacgggatgcatctggcaaaaagaaaaaagggggctcgctcccgtaactggagaagtcggctggctgtgggtctttatatcggcggggtgaccaagtcccgctcgccgcggccgtcctcgaaccgggttctgccgcgactcaaccctggcgatgcttctccagactacgggcgcgagccactacccggcggggttttcgaccgctttcaagtctag

SEQ ID NO: 1146 - DNA, 1854 bp, Adenovirus D25
  MISC_FEATURE (1)..(1854): D25.orf00052 pTP
atggactatttcctgccgctgcgcaacatctggaaccgcgtccgcgagttcccgcgcgcctccaccaccgccgccggcatcacctggatgtcccgctacctctacggctaccaccgcctcatgctcgaggacctggccccgggcgcgccggccacccagcgctggccgctctaccgccagccgccgccgcacttcctagtcggataccagtacctcgtgcgcacctgcaacgactacgtcttcgactcgcgcgccttctcgcggctcaggtactccgaggtcgtgcagcccggcctgcagaccgtcaactggtcgctcatggccaactgcacctacaccatcaacaccggggcctatcaccgcttcgtcgacatggacgacttccaggacaccctcacccgcgtgcaacaggccatcctcgccgagcgcgtcgtcgccgacctggcgctcgtacagccgctcaggggcgtcggggtcacccgcatggaagactccgcctcagccagtgatgacattgagaggctcatgcatgactactacaagaacctgagccggtgtcagggccaggcctggggcatggccgagcggctccgcatccagcaagctggacccaaggacctggtcctcctcgccaccatccgccgcctcaaaaacgcctacttcaattacatcatcagcaaccgcaattctaacagcgtccgcagggctgctacgtgtttgagcttaccttgcgactgcgattggctagacgctttcctcgaaagattctccgatccggtcgatctcgacgcgctcacgtcccctacaccgcaattgataagatgcatcgtcagcgccctatcgctgcccaatggggacccgccccattaccgggagatgaccggcggcgtcttcacgctgcgtcctcgcgaacggggtcgcgccgtcaccgaaaccatgcgtcgccgccgcggggagatgatcgagcgcttcgtcgaccgtctcccggtgcgtcgccgtcgtcgtcggcccccgccaccaccaccgcccccagaggaagaaatagaagaagaggtcgtcatggaagaagaggaagaggaggaggcccccggggatttcgagcgcgaggtgcgcgccaccatcgccgaactcatccggctcctggaagacgagctcacggtctcggcccgcaacgcccagtttttcaacttcgccgtggacttctacgaggccatggaaaggctggaagccatcggcgacatcagcgagatgcccctgcgccgctggatcatgtacttcttcgtcaccgagcacatcgccaccaccctcaactacctcttccagcgcctgcgcaactacgccgtctttgcgcggcacgtggagctcaacctcgcgcaggtggtcatgcgcgcgcgcgacgccgacggggacgtggtctacagccgcgtctggaacgagagcggcctgggcgccttctcgcagctcatgggtcgcatctcgaatgacctcgccgccaccgtcgagcgcgcgggccgcggcgatctccaggaggaggagatcgagcagttcatgtccgagatcgcctaccaggacaactcgggcgacgtgcaagagatcctgcgtcaggccgccgtcaatgacgccgaaattgattctgttgaactgtctttcaggttcaaagtcacggggccagtggtcttcacgcagaggcggcagatccaggatgtcaaccgccgcgtcgtcgcgcacgccagcgctctcagggcgcagcaccgggacctgcccgagcgccacgccgacgtgcctctgccgcccctgcccgcggggccggaaccgccgctgccgccgggagcgcgtccgcgacaccgcttctaa

SEQ ID NO: 1147 - DNA, 3300 bp, Adenovirus D25
  MISC_FEATURE (1)..(3300): D25.orf00055 E2B DNA polymerase
gtggccccgcgcagctacgggctcatgcaatgcgtggacacgaccaccaactcacccgtagaaatcaagtaccatctgcatctcaagcacgccctcacccgcctctacgaggtcaacctcagaaccctgcccccggacctggatctccgcgacaccatggacagctcccaactgcgcgccctcgtcttcgctctccgcccccgccgcgccgatatctggacctggctcccgcgcgggctcgtcagcctctccgtcctcgaggagccccagggtgagtcccacgcaggcgaacatgaaaaccaccagccagggccgccactcctgaagttcctcctcaagggacgcgctgtgtatctcgtggatgaggtacagcccgtgcagcgctgcgagtactgcggacgcttttacaagcatcagcacgagtgctcggttcgccggcgggatttctactttcatcacatcaacagccactcgtccaactggtggcaggaaatccagttcttcccaatcggctctcatcctcgcacggagcggctctttgtcacctacgatgtagaaacctacacctggatggggtccttcggcaagcagctcgtccccttcatgctggtcatgaaattctccggggaccccgagctggtcgccctcgctcgcgatctcgccgtgcgcttacgctgggatcgctgggagcgggaccccctcaccttctactgcgtcaccccagaaaagatggccgtgggccagcagttccgcctctttcgcgacgagctccagaccctcatggcccgcgagctctgggcttccttcatgcaagccaacccacatctccaggagtgggcgctcgagcagcacggcctgcaatgccccgaggacctcacctacgaggagctcaaaaagctgccgcacatcaaaggccgcccgcgattcatggaactctacatcgtcgggcacaacatcaacggcttcgacgagatcgtcctcgccgcccaggtcatcaacaaccgagcctccgtcccgggccctttccgcatcacccgcaatttcatgccgcgggcaggcaagattctcttcaatgacgtcactttcgctctgcctaaccccctctcaaagaagcgcaccgatttcgagctctgggagcacggcggctgcgacgactcggatttcaagtaccagttcttgaaagtcatggtcagggacacctttgccctgacgcacacctcgctccgcaaggccgctcaagcttacgccctccccgtggagaagggctgctgtccctacaaggccgtgaaccatttctacatgctgggctcttaccgtgcggacgatcgaggattcccgctccgggagtactggaaggatgacgaggaatacgccctcaaccgcgagctgtgggagaagaaaggagaggcgagttatgacatcatccgcgaaacgctggactactgcgccatggacgtcctcgtcaccgccgagctcgtcgccaagctgcaagactcctacgcgcacttcatccgcgactcggtccgcctgccccacgcccactttaacatcttccaacgacccaccatctcctccaactcgcatgccatctttcgccagatcgtcttccgcgccgagcagccgcagcgcaccaatctcggccccgccttcttggccccctcgcacgagttgtatgactacgtgcgcgccagcatccgcggggggcgctgctatcccacctacatcggcatcctctcggagcccatctatgtctatgacatctgcggcatgtacgcctccgccctcacgcatcccatgccttggggtccgcccctcaacccctacgagcgagcgctggccgcccgcgagtggcagatggccttggacgatgcatcctcaaaaatcgattattttgacaaggaactctgtccgggcatcttcaccatcgatgcggacccccctgacgagcatctgcttgatgtgctgcccccgttctgctcgcgcaagggcggcagactctgctggaccaacgagcccctgcgcggcgaggtggccaccagcgtggacctggtcaccctgcataaccgcggctggcgcgtcaggatcgtgcccgacgagcgcaccaccgtcttccccgaatggaagtgtgtcgcgcgcgaatatgtccagctcaacatcgcggccaaggagcgcgccgaccgtgacaaaaatcagaccatgagatccatcgccaagcttctctcaaacgccctctatggctccttcgccaccaagcttgacaataaaaaaatagtcttttctgaccagatggatgaaagtctcctaaaaagcatcgcggcagggcaggccaacatcaaatcctcctcgtttctagaaactgacaacctgagtgccgaggtcatgcccgctcttgagagggaatacctaccccaacagctggcgctcgtggacagcgacgcggaagagagtgaggacgagcacagacccgcccccttttatacccccccgtctgggacccccggtcacgtggcctacacctacaagccaatcaccttcttggatgcggaggagggggacatgtgtctgcacacggtggaaaaggtggaccccctggtggacaacgaccgctacccctcgcacgtggcctcctttgtcttggcgtggacgcgcgccttcgtctcagagtggtctgagtttctctacgaggaggaccgcgggacgcccctgcaggacaggcccatcaagtccgtctacggggacacagacagcctgtttgtcaccgagcgcggacacagactcatggagacgcgaggtaagaagcgcatcaaaaagaacgggggaaaactggtttttgaccccgagcagcccgagctcacctggctagtcgagtgcgagaccgtctgcgcccactgcggagcggacgccttcgcccccgagtccgtctttcttgcgcccaagctctacgccctgcaatccctcctctgtcccgcctgcgggcgctcttccaagggcaagctccgcgccaagggccacgccgccgaggccctcaactacgagctcatggtcaactgctatctcgccgacgcgcagggcgaagaccgtgcccgtttcagcaccagcaggatgagtctcaagcgcacccttgcaagcgcccaacccggggcccaccccttcaccgtgacggagaccaccctcacgcggaccctgagaccctggaaggacatgacgctggccgcgctggacgcccatcgtctcgtgccctacagtcgcagtcgtcccaacccccgaaacgaggaagtctgctggatcgagatgccgtag

SEQ ID NO: 1148 - DNA, 1047 bp, Adenovirus D25
  MISC_FEATURE (1)..(1047): D25.orf00056 pIVa2 protein
atgcccatggccgacgggctcaagcccctgaaaaactttgcttccctgcaagagcttctctcgctgggcggggaccgcctcctcggcgagctcgtccgggaaaacctccaagtcagagacatgctcaacgaggtggcccccctcctccgggacgacggcagctgcatgtccttgaactaccacctgcaacccgtcatcggggtcatctacggcccgaccgggtgcggcaagtcccagctgttgagaaacctgctctcctcgcagctcatcacccccgccccggaaaccgtttttttcatcgccccgcaggtggacatgatccccccctccgagatgaaagcctgggagatgcagatctgcgaggggaacttcgccccggggcccgagggaaccatcgtcccccaatctggcaccctccgccccaaattcattaaaatgtcttatgatgatctcacccaggagcataattacgatgtctctgaccccagaaacgtctttgccaaagccgcagcccacgggcccattgccatcatcatggatgagtgcatggaaaacctgggcgggcacaagggcgtctccaaattcttccacgcattcccttccaagttgcatgacaagttccccaagtgcacgggctacaccgttctggtggtcctgcacaacatgaacccccggcgggatctgggtggcaacatcgccaacctcaagatccaggccaaactgcacatcatctccccccgcatgcatccctcccagctcaaccgttttgccaacacctacaccaaggggctccccgtggccatcagtctcctcctcaaggacatcatccagcaccacgcccagcgcccctgctatgactggatcatctacaacacgaccccagagcacgaggccatgcagtggtgctacctccacccccgggacgggctcatgcccatgtacctcaacatccaatcccacctctaccgggtcctggaaaaaatccaccgcactctcaatgatcgggagaggtggaccagggcctaccgcgcgcgaaaaaataaataa

SEQ ID NO: 1149 - DNA, 312 bp, Adenovirus D25
  MISC_FEATURE (1)..(312): D25.orf00059 IX pIX
atgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatga

SEQ ID NO: 1150 - DNA, 1428 bp, Adenovirus D25
  MISC_FEATURE (1)..(1428): D25.orf00061 E1B 55 kDa protein
gtggagggcctggatcaggcagcggggacagagaatcttgaactactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagtgaagagggagaggagcgatgggggcaataccgggatgatgaccgagctgactgccagcctgatgaatcgcaagcgcccagagcgcattacctggcatgagctacagatggagtgcagggatgagataggcctgatgcaggataaatatggtctggagcagataaaaacccactggttaaacccagatgaggattgggaggaggccattaagaaatatgccaagatagccctgcgcccagattgcaagtacagggtgaccaagacggtgaatatcagacatgcctgctacatctcggggaacggggcagaggtggtcatcgataccctggacaaggccgccttcaggtgttgcatgatgggaatgagagccggagtgatgaatatgaattccatgatcttcatgaacatgaagttcaatggagagaagtttaatggagtgatgttcatggccaacagccacatgaccctgcatggctgtagtttcttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtttctaccgagggcaatgctagagtgagacattgctcttccctggagacgggctgcttctgcctggtgaagggtacagcctctctgaagcataatatggtgaagggatgcacggatgagcgcatgtacaacatgctgacctgcgactcgggagtctgtcatatcctgaaaaacatccatgtgacctcccaccccagaaagaagtggccagtgtttgagaataacctgctgatcaagtgccatatgcacctgggcgccagaaggggcaccttccagccgtaccagtgcaactttagtcagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccagaatgcaaccagtggccctggatgtgaccgaggagctgagaccagaccacctggtgatggcctgtaccgggaccgagttcagctccagtggggaggatacagattag

SEQ ID NO: 1151 - DNA, 180 bp, Adenovirus D25
  MISC_FEATURE (1)..(180): D25.orf00062 E1B 19k protein
gtgcatggctgcgaagtccaggatgtatcccctgctcagttgggtgtcctggctccatttgtcaaccagaaaaaccacaaaagcaaccccggctgtagtgcgccctggactggaaaaatcaaggctgtggagtaccctttcctggaaaagggactggtggccaagattcagagaatctag

SEQ ID NO: 1152 - DNA, 207 bp, Adenovirus D25
  MISC_FEATURE (1)..(207): D25.orf00064 E1A 14.9 kDa protein
gtgtcagaggatgagtcatcaccctcagaagaagaccacccgtctccccctgatctcacagatgacacgcccctgcaagtgatcagacccaccccagtcagactcagtggggagaggcgaatggctgttgacaaaatcgaggacttgttgcaggacatgggtggggatgaacctttagacctgagcttgaaacgccccaggaactag

SEQ ID NO: 1153 - DNA, 579 bp, Adenovirus D25
  MISC_FEATURE (1)..(579): D25.orf00065 E1A 28 kDa protein
atgagacacctgcgtctcctgcctggaactgtgcccttggacatggccgcattattgctggatgactttgtgagtacagtattggaggatgaactgcaaccaactccgttcgagctggggcccacacttcaggacctctatgatctggaggtagatgcccaggaggacgacccgaacgaagaggctgtgaatttaatatttccagaatctctgattcttcaggctgacatagccagcgaagctgtacctacaccacttcatacaccgactctgtcacccatacctgaattggaagaggaggacgaactagacctccggtgttatgaggaaggttttcctcccagcgattcagaggacgaacggggtgagcagagtatggctataatctcagactatgcttgtgtggttgtggaagagcattttgtgttggacaatcctgaggtgcctgggcaaggctgtagatcctgccaatatcaccgggatcagaccggagaccaaaatgcttcctgtgctctgtgttacatgaaaatgagcttcagctttatttacagtaagtggagtgaatgtgagagaggctga

SEQ ID NO: 1154 - DNA, 378 bp, Adenovirus D26; identical to SEQ ID NO: 1114
  MISC_FEATURE (1)..(378): D26.orf00002 E4 ORF1 protein

SEQ ID NO: 1155 - DNA, 393 bp, Adenovirus D26; identical to SEQ ID NO: 1115
  MISC_FEATURE (1)..(393): D26.orf00003 E4 ORF2 protein

SEQ ID NO: 1156 - DNA, 354 bp, Adenovirus D26; identical to SEQ ID NO: 1116
  MISC_FEATURE (1)..(354): D26.orf00005 E4 ORF3 protein

SEQ ID NO: 1157 - DNA, 363 bp, Adenovirus D26; identical to SEQ ID NO: 1117
  MISC_FEATURE (1)..(363): D26.orf00007 E4 ORF4 protein

SEQ ID NO: 1158 - DNA, 663 bp, Adenovirus D26
  MISC_FEATURE (1)..(663): D26.orf00010 E4 34.1 K E4 ORF6 34.1 kDa protein
atgatcctgaccccagaggaaataaaaattttaaaaagatgtatgtcagtgtgcctgtgccccgctaccctggacttggtgagagctcagatggtgagcgggtacgagcgctggatcctgcattgccactgttcagccccgggatccctgcagtgtcgggcgggaggcaccatgctggccgtgtggttcaggagagtcatttacgggtgcatgttcaaccagcgattcccatggtaccggcagattgtgaacagaaacatgcccaaagagatcatgtatatgggcagtgtgttcatgaggggcaggcacctgatatactgccgcatctggtacgatggtcacgtgggttccatcatccccaacatgagctttggttggagcgccctgaattatgggctgctgaataacatggtgattatgtgctgcacttactgtgagaacatggcagagatcaggatgcggtgctgtgcccgacgcaccaggagactgttgctgaaggctgtggggatcatagtcagagagacttgcgatcccgatcccatctgcagcagccgcaccgagccccggcggcaaagactgttgagggcgctgatggagaggcacagacccatcctgttttccgagtatgaatctgtgcgttcttctcattccaccagactgtga

SEQ ID NO: 1159 - DNA, 246 bp, Adenovirus D26
  MISC_FEATURE (1)..(246): D26.orf00012 E4 ORF6/7 protein
gtgaccttggactgtgaggcccgcttggatgacttttcagaggacggcttcatctcaatcaccgacccccgtttggctcgccaggaaactgtgtggattatagaccccaagtccagttcccgcactaatcagaacatttccctatttaaggccacccgtgctgagagaattgtttacactgtgaaatgggctggtggtgggaaactgactacccgtgctggtgtaaaaataaataaagattcataa

SEQ ID NO: 1160 - DNA, 1125 bp, Adenovirus D26; identical to SEQ ID NO: 154
  MISC_FEATURE (1)..(1125): D26.orf00013 L5 fiber

SEQ ID NO: 1161 - DNA, 150 bp, Adenovirus D26
  MISC_FEATURE (1)..(150): D26.orf00014 U protein
atgaaaattgtggaccaggaatttgacatccctttcaaggtgtggaggaagttcgccgcccgccggggactggagtaccagagctgggaggagggtaccgaggtgctgctgaacaactacaccagagacatactttcagatttcaagtaa

SEQ ID NO: 1162 - DNA, 393 bp, Adenovirus D26
  MISC_FEATURE (1)..(393): D26.orf00018 E3 14.7 kDa protein
atgactgaccaccacctggacctcgagatggacggccaggcctccgagcagcgcatcctgcaactgcgcgtccgtcagcagcaggagcgtgccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctgctcaagaccctttgcggactccgcgacctcctccccatgaactga

SEQ ID NO: 1163 - DNA, 393 bp, Adenovirus D26
  MISC_FEATURE (1)..(393): D26.orf00020 E3 RID-beta
atgcagactctgctcatactgctatccctcctatcccctaccctcgccacttctgctgattactctaaatgcaaattcgcggacatatggaatttcttagactgctatcaggagaaaattgacatgccctcctattacttggtgattgtgggaatagttatggtctgctcctgcactttctttgccatcatgatctacccctgttttgatctcggctggaactctgttgaagcattcacatacacactagaaagcagttcactagcctccacgccaccacccacaccgcctccccgcagaaatcagtttcccatgattcagtacttagaagagccccctccccgacccccttccactgttagctactttcacataaccggcggcgatgactga

SEQ ID NO: 1164 - DNA, 276 bp, Adenovirus D26
  MISC_FEATURE (1)..(276): D26.orf00021 E3 RID-alpha
atgattcctaggttcttcctatttaacatcctcttctgtctcttcaacgtgtgcgctgccttcgcggccgtctcgcacgcctcacccgactgtctcgggcccttccccacctacctcctctttgccctgctcacctgcacctgcgtctgcagcattgtctgcctggtcatcaccttcctgcagctcatcgactggtgctgcgcgcgctacaattacctgcatcatagtcccgaatacagggacgagaacgtagccagaatcttaaggctcatatga

SEQ ID NO: 1165 - DNA, 783 bp, Adenovirus D26
  MISC_FEATURE (1)..(783): D26.orf00023 E3 CR1-gamma
atgaaggctttcacagcttgcgttctgattagcatagtcacacttagtgcagctgaagctaaatgctttcatacttataacttaactagaggggaaaatattacattagcaggtgctggcttaaacacaacatgggaagcatatcacaatggatggaaacaagtttgtccatggaatgacggtcgctatgtgtgcgttggaaacagcagtaccataactaatcttacagttgtagctaatgcaaatttatcatcaactgttaaatttagagctgaaagtttatacattggaacagatggatatgaaagcaatccatcatgcttttatactatcaatgtaattgagcttccaaccaccagatcgccaactaccaccacggtcagtacaactactgagaccacaactcacactacacagttagacactacagtgcagaatagtactgtattggttaggtatttgttaagggaggaaagtactactgaacagacagaggctacctcaagcgccttcagcagcacttcaaatttaacttcgcttgcttggactaatgaaaccggagtatcattgatgcatggccagccttactcaggtttggatattcaaattacttttctggttgtctgtgggatctttattcttgtggttcttctgtactttgtctgctgcaaagccagagaaaaatctaggcggcccatctacaggccagtaatcggggaacctcagccactccaagtggatggaggcttaaggaatcttcttttctcttttacagtatggtga

SEQ ID NO: 1166 - DNA, 1254 bp, Adenovirus D26
  MISC_FEATURE (1)..(1254): D26.orf00024 E3 CR1-beta
atgaatgctttgaccagtgtcgtgctgctctctcttcttgtagcttttagtaatggggaagctgaaactgtagttgtaaatgttaaatctggtacaaaccacacccttgaaggtcctagaaaaactccagttcagtggtatgggggtgctaactttgacatgttttgcaatggctctaaaatacatcacaatgaattgaatcacacttgctctattcagaacataactcttacattcataaacagaacacatcatggaacatactatggttttggctctgacaatcaaaattcaaaagtgtatcatgtcagagtagatgtagagcctcctagaccccgtgctactttggctcctcctcaggacataactattaagtatggctcaaatagaacattgcagggcccaagtgttactccagttagttggtatgatggtgaaggaaatcggttttgcgatggcgataaaattgatcatacagaaattaatcacacttgcaatgctcaaaaccttactttgctgtttgtgaatgaaacacatgaaagaacatattatggaattagtggtgattggaaacagcgaaatgagtatgatgttactgttacaaagacacaattaaatattaaaaatttgggccaacgcaaaactgatgaaaaccataaaaatggaatgcatcagaaagtcgaacaaaatcctgaaactaagaaagaacagaagccttcaaaaagacctagacaaaaaacattgcaaactacaattcaggttatgattcctattggaactaattatactttagtggggccttcgccaccagtgagctggcatactacaaaaaatggcttaacagaactctgtaatggaaaccctattttaagacacacttgtgatgggcaaaatattacacttattaatgttaatgctacatttgaggctgattactatggctcgaacaataagagtgaatcaaaacactacagagtcaaggttttcaaagaaagaaaagatcaggcactattattcagaccgcttactaccaaaggaagcatgatcattactactgaaaatcaaaactttgaattacaacaaggtgacaatcaagatgatgacaaaattccatcaactactgtggcaatcgtggtgggtgtgattgcgggctttgtgactctgatcattgtcttcatatgctacatctgctgccgcaagcgtcccaggtcatacaatcatatggtagacccactactcagcttctcttactga

SEQ ID NO: 1167 - DNA, 474 bp, Adenovirus D26
  MISC_FEATURE (1)..(474): D26.orf00025 E3 gp 17.6 kDa protein
atgaaggggcttttgctgattatccttttcatggtggggggtgtactgtcatgccacgaacagccacgatgtaacatcaccacaggcaatcatatgagcagagagtgcactgtagtcatcaaatgcgagcacgactgcccactaaacattacattcaagaataacaccatgggaaatgtatgggtgggtttctgggaaccaggagatgagcagaactacacggtcactgtccatggtagcaatggaaatcacactttcggtttcaaattcatttttgaagtcatgtgtgatatcacactgcatgtggctagacttcatggcttgtggccccctaccaaggagaacatggttgggttttctttggcttttgtgatcatggcctgcttgatgtcaggtctgctggtaggggctttagtgtggttcctgaagcgcaagcctaggtacggaaatgaagaaaaggaaaaattgctataa

SEQ ID NO: 1168 - DNA, 561 bp, Adenovirus D26
  MISC_FEATURE (1)..(561): D26.orf00026 E3 21.8 K E3 21.8 kDa protein
gtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcaacgacggtgttgaacttcccaacaacctttccagtggactgagttacgatacacatagagctaagctcgtcctctacaatccttttgtagagggaacctaccagtgccagagcggaccttgtactcacaccttccatttggtgaacgtcaccagcagcagcaacagctcagaaactaaccttccttctgatactaacaaacctcgtttcggaggtgagctaaggcttcccccttctgaggagggggttagcccatacgaagtggtcgggtatttgattttaggggtggtcctgggtgggtgcatagcggtgctagctcagctgccttgctgggtggaaatcaaaatctttatatgctgggtcagatattgtggggaggaaccatga

SEQ ID NO: 1169 - DNA, 321 bp, Adenovirus D26
  MISC_FEATURE (1)..(321): D26.orf00027 E3 12.2 K E3 12.2 kDa protein
atgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaa

SEQ ID NO: 1170 - DNA, 684 bp, Adenovirus D26
  MISC_FEATURE (1)..(684): D26.orf00029 L4 pVIII L4 pVIII protein
atgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactga

SEQ ID NO: 1171 - DNA, 219 bp, Adenovirus D26; identical to SEQ ID NO: 912
  MISC_FEATURE (1)..(219): D26.orf00030 L4 20 kDa protein

SEQ ID NO: 1172 - DNA, 186 bp, Adenovirus D26
  MISC_FEATURE (1)..(186): D26.orf00033 L4 22 kDa protein
gtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtaaacatcccccgcaacgtgttgcattactaccgtcaccttcacagctaa

SEQ ID NO: 1173 - DNA, 2199 bp, Adenovirus D26
  MISC_FEATURE (1)..(2199): D26.orf00035 L4 100 kDa protein
atggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccacgacccccaggctttggaacagcggcgcaagctcatgctggccgtggtcctggttaccctcgagctggaatgcatgcgccgcttcttcagcgaccccgagaccctgcgcaaggtcgaggagaccctgcactacactttcagacacggtttcgtcaggcaggcctgcaagatctccaacgtggagctgaccaacctggtctcctgcctggggatcctgcacgagaaccgcctggggcagaccgtgctccactctaccctgaagggcgaggcgcggcgggactatgtccgcgactgcgtctttctatttctttgccacacatggcaagcagccatgggcgtgtggcaacagtgtctcgaggacgataacctgaaggagctggacaagcttcttgctagaaatcttaaaaagctgtggacgggcttcgacgagcgcaccgtcgcctcggacctggccgagatcgtgttccccgagcgcctgaggcagacgctgaaaggcgggctgcccgacttcatgagccagagcatgttgcaaaactaccgcactttcattctcgagcgatctgggatgctgcccgccacctgcaacgctttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctactaagcgagacccaggtcatcggtacctttgagctgcaaggtccgcaggagtccaccgctccgctgaaactcacgccggggttgtggacttccgcgtacctgcgcaaatttgtacccgaggactaccacgcccacgagataaagttcttcgaggaccaatcgcgtccgcagcacgcggatctcacggcctgcgtcatcacccagggcgcaatcctcgcccaattgcacgccatccaaaaatcccgccaagagtttcttctgaaaaagggtagaggggtctacctggacccccagacgggcgaagtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgcagctccggccaagcctcctcgtag

SEQ ID NO: 1174 - DNA, 1470 bp, Adenovirus D26
  MISC_FEATURE (1)..(1470): D26.orf00036 E2A DNA-binding protein
atggccggcggcagtcaggacgtgcgccggttcatgggccgagaggccactccgccccggggccacgggtcggcgcgctatccgccggagcaggagaggagcccctcgccgccacctcctctgcccaccaagcgccgaaagtatcagcgggtgggctccgggtcttccgaggaggacgtgctccccgtggacagccctccaaaaaagaagcaagccagaaagaccaagcatgtgaccaaggtagaccccgacgaagagatgccccaggaagatgccgtgatcgtgggagtgggattcagccagccgccggttctattgaaggaaggcaaggacggaaaacgcatcgtcgagcccgcgacccccggtgtcctgaacgtacgcaaccctctgagtctgcctctggtctcgtcctgggagaagggcatggataccatgaacgtgctgatggaacgctaccgcgtcgacagcggcctgcgcgatgcttacaagctcatgcccgagcagaccgagatcttccagaagatgtgccagacctggatgaacgaggaggcccgcgggatgcaactgaccttcaccacccagaaagcatttagcaccatcatgggccgcatgttgcaaggttacatcttcagccacagcgggattgcgcacaagaactgggagtgcaccggttgcgccctgtgggatcacggctgcaccgaggtggaaggccagctcaagtgtctgcacgggacgatgatgatccacaaggaccacgtggtggagatggatgtgaccagcgagaacgggcagcgcgcgttgaaggagcagcccagcaaggctaaggtgacccagaaccgctggggacggagcgtggtgcaactgaccagccatgacgcgcgctgctgcgtgcaggatgccgggtgtgggaataaccagttcagcgggaagagctgcggcctgtttttcagcgagggggccaaggcccagcaagctttcaagcagatcgcggcctttgtcaaggccctctacccgaatatgcagcgcggcgcggggatgatgctgatgcccgtgcactgcgagtgtaaccacaagcctcagagcgtgcccttcctgggacgccagctgtgcaagatgaccccgttcggcctgagcaacgccgaggatctggacaaggatcagatcagcgacaagagcgtgctggctagtgtgaagtaccccagtctgatggtgttccagtgctgcaaccccgtgtaccgcaactcgcgcgcgcagagcaccggccccaactgcgatttcaagatctccgccccggacatgctgggcgccctgcagatgagccggcgcatgtggagcgagaccttccccgagaccccagtgcccaaactggtgatccccgagttcaagtggcagcccaagtaccagtaccgcaacgtggccctccccagcgcggcgcacaacgacgagcgcgagaaccccttcgacttttaa

SEQ ID NO: 1175 - DNA, 630 bp, Adenovirus D26
  MISC_FEATURE (1)..(630): D26.orf00038 L3 23.6 kDa protease
atgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataa

SEQ ID NO: 1176 - DNA, 2889 bp, Adenovirus D26; identical to SEQ ID NO: 214
  MISC_FEATURE (1)..(2889): D26.orf00041 L3 hexon

SEQ ID NO: 1177 - DNA, 705 bp, Adenovirus D26
  MISC_FEATURE (1)..(705): D26.orf00042 L3 pVI
atggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaaaggcgaaaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattga

SEQ ID NO: 1178 - DNA, 1005 bp, Adenovirus D26; identical to SEQ ID NO: 956
  MISC_FEATURE (1)..(1005): D26.orf00044 L2 pV

SEQ ID NO: 1179 - DNA, 588 bp, Adenovirus D26
  MISC_FEATURE (1)..(588): D26.orf00045 L2 pVII
atgtctattctcatctcgcccagcaataacaccggctggggtcttactagacccagcaccatgtacggaggagccaagaagcgctcccagcagcaccccgtccgcgtccgcggccacttccgcgctccctggggcgcttacaagcgcgggcggacttccaccgccgccgtgcgcaccaccgtcgacgacgtcatcgactcggtggtcgccgacgcgcgcaactacactcccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctga

SEQ ID NO: 1180 - DNA, 1560 bp, Adenovirus D26; identical to SEQ ID NO: 184
  MISC_FEATURE (1)..(1560): D26.orf00046 L2-pIII penton

SEQ ID NO: 1181 - DNA, 1596 bp, Adenovirus D26
  MISC_FEATURE (1)..(1596): D26.orf00050 L1 pIIIa
atgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttga

SEQ ID NO: 1182 - DNA, 1122 bp, Adenovirus D26
  MISC_FEATURE (1)..(1122): D26.orf00051 L1 52 kDa protein
atgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactga

SEQ ID NO: 1183 - DNA, 210 bp, Artificial Sequence
  D26.orf00052 hypothetical protein
atgcatctggcaaaaagaaaaaagggggctcgctcccgtaactggagaagtcggctggctgtgggtctttatatcggcggggtgaccaagtcccgctcgccgcggccgtcctcgaaccgggttctgccgcgactcaaccctggcgatgcttctccagactacgggcgcgagccactacccggcagggttttcggtcgctttcaagtctag

SEQ ID NO: 1184 - DNA, 1854 bp, Adenovirus D26
  MISC_FEATURE (1)..(1854): D26.orf00055 pTP
atggactatttcctgccgctgcgcaacatctggaaccgcgtccgcgagttcccgcgcgcctccaccaccgccgccggcatcacctggatgtcccgctacctctacggctaccaccgcctcatgctcgaggacctggccccgggcgcgccggccacccagcgctggccgctctaccgccagccgccgccgcacttcctagtcggataccagtacctcgtgcgcacctgcaacgactacgtcttcgactcgcgcgccttctcgcggctcaggtactccgaggtcgtgcagccaggcctgcagaccgtcaactggtcgctcatggccaactgcacctacaccatcaacaccggggcctatcaccgcttcgtcgacatggacgacttccaggacaccctcacccgcgtgcaacaggccatcctcgccgagcgcgtcgtcgccgacctggcgctcgtgcagccgctcaggggcgtcggggtcacccgcatggaagactccgcctcagccagtgatgacattgagaggctcatgcatgactactacaagaacctgagccggtgtcagggccaggcctggggcatggccgagcggctccgcatccagcaagctggacccaaggacctggtcctcctcgccaccatccgccgcctcaaaaacgcctacttcaattacatcatcagcaaccgcaattctaacagcgtccgcagggctgctacgtgtttgagcttaccttgcgactgcgattggctagacgctttcctcgaaagattctccgatccggtcgatctcgacgcgctcacgtcccctacaccgcaattgataagatgcatcgtcagcgccctatcgctgcccaatggggacccgccccattaccgggagatgaccggcggcgtcttcacgctgcgtcctcgcgaacggggtcgcgccgtcaccgaaaccatgcgtcgccgccgcggggagatgatcgagcgcttcgtcgaccgtctcccggtgcgtcgccgtcgtcgtcggcccccgccaccaccaccgcccccagaggaagaaatagaagaagaggtcgtcatggaagaagaggaagaggaggaggcccccggggatttcgagcgcgaggtgcgcgccaccatcgccgaactcatccggctcctggaagacgagctcacggtctcggcccgcaacgcccagtttttcaacttcgccgtggacttctacgaggccatggaaaggctggaagccatcggcgacatcagcgagatgcccctgcgccgctggatcatgtacttcttcgtcaccgagcacatcgccaccaccctcaactacctcttccagcgcctgcgcaactacgccgtctttgcgcggcacgtggagctcaacctcgcgcaggtggtcatgcgcgcgcgcgacgccgacggggacgtggtctacagccgcgtctggaacgagagcggcctgggcgccttctcgcagctcatgggtcgcatctccaatgacctcgccgccaccgtggagcgcgcgggccgcggcgatctccaggaggaggagatcgaacagttcatgtccgagatcgcctaccaggacaactcgggcgacgtgcaagagatcctgcgtcaggccgccgtcaatgacgcagagattgattctgttgaactgtctttcaggttcaaagtcacggggcccgtggtcttcacgcagaggcggcagatccaggatgtcaaccgccgcgtcgtcgcgcacgccagcgctctcagggcgcagcaccgggacctgcccgagcgccacgccgacgtgcctctgccgcccctgcccgcggggccggaaccgccgctgccgccgggagcgcgtccgcgacaccgcttctaa

SEQ ID NO: 1185 - DNA, 3276 bp, Adenovirus D26
  MISC_FEATURE (1)..(3276): D26.orf00059 E2B DNA polymerase
atgcaatgcgtggacacgaccaccaactcacccgtagaaatcaagtaccatctgcatctcaagcacgccctcacccgcctctacgaggtcaacctcagaaccctgcccccggacctggatctccgcgacaccatggacagctcccaactgcgcgccctcgtcttcgctctccgcccccgccgcgccgagatctggacctggctcccgcgcgggctcgtcagcctctccgtcctcgaggagccccagggtgagtcccacgcaggcgaacatgaaaaccaccagccagggccgccactcctgaagttcctcctcaagggacgcgctgtgtatctcgtggatgaggtacagcccgtgcagcgctgcgagtactgcggacgcttttacaagcatcagcacgagtgctcggttcgccggcgggatttctactttcatcacatcaacagccactcgtccaactggtggcaggaaatccagttcttcccaatcggctctcatcctcgcacggagcggctctttgtcacctacgatgtagaaacctacacctggatggggtccttcggcaagcagctcgtccccttcatgctggtcatgaaattctccggggacccagagctggtcgccctcgctcgcgatctcgccgtgcgtttacgctgggatcgctgggagcgggaccccctcaccttctactgcgtcaccccagaaaagatggccgtgggccagcagttccgcctctttcgcgacgagctccagaccctcatggcccgcgagctctgggcttccttcatgcaagccaacccacatctccaggagtgggcgctcgagcagcacggcctgcaatgccccgaggacctcacctacgaggagctcaaaaagctgccgcacatcaaaggccgcccgcgattcatggaactctacatcgtcgggcacaacatcaacggctttgacgagatcgtcctcgccgcccaggtcatcaacaaccgagcctccgtcccgggccctttccgcatcacccgcaatttcatgccgcgggcaggcaagattctcttcaatgacgtcactttcgctctgcctaaccccctctcgaagaagcgcaccgatttcgagctctgggagcacggcggctgcgacgactcggacttcaagtaccagttcttgaaagtcatggtcagggacacctttgccctgacgcacacctcgctccgcaaggccgctcaagcttacgccctccccgtggagaagggctgctgtccctacaaggccgtgaaccatttctacatgctgggctcttaccgtgcggacgatcgaggattcccgctccgggagtactggaaggatgacgaggaatacgccctcaaccgcgagctgtgggagaagaaaggagaggcgagttatgacatcatccgcgaaacgctggactactgcgccatggacgtcctcgtcaccgccgagctcgtcgccaagctgcaagactcctacgcgcacttcatccgcgactcggtccgcctgcctcacgcccactttaacatcttccaacggcccaccatctcctccaactcgcacgccatctttcgccagatcgtcttccgcgccgagcagccccagcgcaccaatctcggccccgccttcttggccccctcgcacgagttgtatgactacgtgcgcgcaagcatccgcggggggcgctgctatcccacctacatcggcatcctctcggagcccatctatgtctatgacatctgcggcatgtacgcctccgccctcacgcatcccatgccttggggtccgcccctcaacccctacgagcgagcgctggccgcccgcgagtggcagatggccttggacgatgcatcctcaaaaatcgattattttgacaaggaactctgtccgggcatcttcaccatcgatgcggacccccctgacgagcatctgcttgatgtgctgcccccgttctgctcgcgcaagggcggcagactctgctggaccaacgagcccctgcgcggcgaggtggccaccagcgtggacctggtcaccctgcataaccgcggctggcgcgtcaggatcgtgcccgacgagcgcaccaccgtcttccccgaatggaagtgtgtcgcgcgcgaatatgtccagctcaacatcgcggccaaggagcgcgccgaccgtgacaaaaatcagaccatgagatccatcgccaagcttctctcaaacgccctctatggctccttcgccaccaagcttgacaataaaaaaatagtcttttctgaccagatggatgaaagtctcctaaaaagcatcgcggcagggcaggcccacatcaaatcctcctcgtttctagaaactgacaacctgagtgccgaggtcatgcccgctcttgagagggaatacctaccccaacagctggcgctcgtggacagcgacgcggaagagagtgaggacgagcacagacccgcccccttttatacccccccgtcgggaaccccaggtcacgtggcctacacctacaagccaatcaccttcttggatgcggaggagggggacatgtgcctgcataccgtggaaaaggtggaccccctggtggacaacgaccgctacccctcgcacgtggcctcctttgtcttggcgtggacgcgcgccttcgtctcagagtggtctgagtttctctacgaggaggaccgcgggacgcccctgcaggacaggcccatcaagtccgtctacggggacacagacagcctgtttgtcaccgagcgcggacacagactcatggagacgcgaggtaagaagcgcatcaaaaagaacgggggaaaactggtttttgaccccgagcagcccgagctcacctggctagtcgagtgcgagaccgtctgcgcccactgcggagcggacgccttcgcccccgagtccgtctttctcgcgcccaagctctacgccctgcaatccctcctctgtcccgcctgcgggcgctcttccaagggcaagctccgcgccaagggccacgccgccgaggccctcaactacgagctcatggtcaactgctatctcgccgacgcgcagggcgaagaccgtgcccgtttcagcaccagcaggatgagtctcaagcgcacccttgcaagcgcccagcccgcggcccaccccttcaccgtgacggagaccaccctcacgcggaccctgagaccctggaaggacatgacgctggccgcgctggacgcccatcgtctcgtgccctacagtcgcagtcgtcccaacccccgaaacgaggaagtctgctggatcgagatgccgtag

SEQ ID NO: 1186 - DNA, 1047 bp, Adenovirus D26
  MISC_FEATURE (1)..(1047): D26.orf00060 pIVa2 protein
atgcccatggccgacgggctcaagcccctgaaaaactttgcttccctgcaagagcttctctcgctgggcggggaccgcctcctcggcgagctcgtccgggaaaacctccaagtcagagacaagctcaacgaggtggcccccctcctccgggacgacggcagctgcatgtccttgaactaccacctgcaacccgtcatcggggtcatctacggcccgaccgggtgcggcaagtcccagctgttgagaaacctgctctcctcgcagctcatcacccccgccccggaaaccgtttttttcatcgccccgcaggtggacatgatccccccctccgagatgaaagcctgggagatgcagatctgcgaggggaacttcgccccggggcccgagggaaccatcgtcccccaatctggcaccctccgccccaaattcattaaaatgtcttatgatgatctcacccaggagcataattacgatgtctctgaccccagaaacgtctttgccaaagccgcagcccacgggcccattgccatcatcatggatgagtgcatggaaaacctgggcgggcacaagggcgtctccaaattcttccacgcattcccttccaagttgcatgacaagttccccaagtgcacgggctacaccgttctggtggtcctgcacaacatgaacccccggcgggatctgggtggcaacatcgccaacctcaagatccaggccaaactgcacatcatctccccccgcatgcatccctcccagctcaaccgttttgccaacacctacaccaaggggctccccgtggccatcagtctcctcctcaaggacatcatccagcaccacgcccagcgcccctgctatgactggatcatctacaacacgaccccagagcacgaggccatgcagtggtgctacctccacccacgggacgggctcatgcccatgtacctcaacatccaatcccacctctaccgggtcctggaaaaaatccaccgcactctcaatgatcgggagaggtggaccagggcctaccgcgcgcgaaaaaataaataa

SEQ ID NO: 1187 - DNA, 405 bp, Adenovirus D26
  MISC_FEATURE (1)..(405): D26.orf00063 IX pIX
atgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatga

SEQ ID NO: 1188 - DNA, 1488 bp, Adenovirus D26
  MISC_FEATURE (1)..(1488): D26.orf00065 E1B 55k E1B 55k protein
atggagccaggacacccaactgagcaggggctacatcctggacttcgcagccatgcacctgtggagggcctggatcaggcagcggggacagagaatcttgaattactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagttaagagggagaggagcgatgggggtaataccgggatgatgaccgagctgacggccagcctgatgaatcggaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttcttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacctgcgattcgggggtctgccatatcctgaagaacatccatgtgacctcccaccccagaaagaagtggccagtgtttgagaataacctgctgatcaagtgccatatgcacctgggagccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggatacagattag

SEQ ID NO: 1189 - DNA, 207 bp, Adenovirus D26; identical to SEQ ID NO: 966
  MISC_FEATURE (1)..(207): D26.orf00068 E1A 14.8 kDa protein

SEQ ID NO: 1190 - DNA, 519 bp, Adenovirus D26
  MISC_FEATURE (1)..(519): D26.orf00070 E1A 28 kDa protein
atgctggaggactttgtggatacagtattggaggacgaactgcatccaagtccgttcgagctgggacccacacttcaggatctctatgatctggaggtagatgcccatgatgacgaccctaacgaggaggctgtgaatttaatatttccagaatctatgattcttcaggctgacatagccaacgaatctactccacttcatacaccgactctgtcacccatacctgaattggaagaggaggacgaactagacctccggtgttatgaggaaggttttcctcccagcgattcagaggatgaacggggtgagcagaccatggctctgatctcagactatgcttgtgtgattgtggaggaacaagtagtgattgaaaattctaccgagccagtggagggctgtagaaaatgccagtaccaccgggataagtctggagacccgaacgcatcatgcgctttgtgctatatgaaacagactttcagctttatttacagtaagtggagtgaatgtgagagaggctga

SEQ ID NO: 1191 - DNA, 126 bp, Artificial Sequence; identical to SEQ ID NO: 932
  D26.orf00071 hypothetical protein

SEQ ID NO: 1192 - DNA, 378 bp, Adenovirus D27
  MISC_FEATURE (1)..(378): D27.orf00003 E4 ORF1 protein
atggctgaatctctgtatgctttcatagatagccctggagggatcgctcccgtccaggaagggactagcaatagatataatttcttttgccccgaatctttccacattcctccgcatggggtggttttggttcacttgagagtgagcgtgctgattcctaatggctaccaaggcagatttatggccttgaatgactaccattccaggggcatactaacccagtccgatgtgatctttgctgggagaagacaggagctaactgtgctgctctttaaccacacggatcgatttttgtatgtccgagagggccacccagtgggcactttgctgctggagagagtgatttttccttcagtaagacttgccactctggtttag

SEQ ID NO: 1193 - DNA, 393 bp, Adenovirus D27
  MISC_FEATURE (1)..(393): D27.orf00004 E4 ORF2 protein
atgcttgagcgacgcgctgtcagctaccacattgtggtccctggggccctagtgacttatttagaggatttttccattactgctatgattagagagcacctacctcgctttatcactcaccttttggaaggaatcaccggtgacacaaagagagcttattccagcgtgcagtttttgggtgctagctttggagcattaaagtactccatcacgcttgccagtcccacgcttagccctggctctgaattggcatctgtagtggccgaggacttgagtgactttttacagctgacgctgagacgcgagctcagggcagagggcagaaactcattgaatcttgttgttttgaacacgctgcaggtggtggagcagccagatttgttgctattatga

SEQ ID NO: 1194 - DNA, 354 bp, Adenovirus D27
  MISC_FEATURE (1)..(354): D27.orf00006 E4 ORF3 protein
atgaaggtctgcctgattatgaaagtggagggggcgctgtgggaacttttccacatgtgcggagtggacttacaccaacaatttgtagaaataattcaaggctggaaaaatgagaattacctgggaatggtgaatgagtgtaacctgatgattgatgaaatcgatggagggccagcctttaatgtgattcttatgctggatgtacgcgtagagccactgctcgaagccacagtcgagcaccttgaaaatagagtaggttttgacctggctgtctgtttccaccagcacagcggcggggaacgctgtcacctgcgtgacttgcactttatcgtccttcgagaccgcttggaataa

SEQ ID NO: 1195 - DNA, 879 bp, Adenovirus D27
  MISC_FEATURE (1)..(879): D27.orf00011 E4 34 kDa protein
atgcaaaccgaggatcagtcgagcttgctccgccatcatccatatcgcagggcccgtttaccacgatctgatgaggagaccagggcctctctgactgaacaacaccctctgttgcccgattgtgatcatgcagattatcataatgtaagttctgtccgtggattgccatgtgctgctggctttaccctgctccaagagtttccagtcccctgggatatgatcctgtccccagaggaaataaaaattttaaaaagatgtatgtcagtgtgcctgtgccccgctaccctggacttggtaagagctcagatggtgagcgggtacgagcgctggatcctgcattgccactgttcatccccgggctccctgcagtgtcgggcgggaggcaccctgctggccgtgtggttcaggagagtcatttacgggtgcatgttcaaccagcgattcccctggtaccggcagattgtgaacagaaacatgcccaaagagatcatgtatatgggcagtgtgttcatgaggggcaggcacctgatatactgccgcatctggtatgatggtcacgtgggttccatcatccccaacatgagctttggctggagcaccctgaattatgggctgctgaataacatggtgattatgtgctgcacttactgtgagaacatgagcgagatcaggatgcggtgctgtgcccgacgcaccaggagactgatgctgaaggctgtggggatcatagtcagagagacttgcgatcccgatcccatctgcagcagccgcaccgagccccggcggcaaagactgttgagggcgctgatggagaggcacagacccatcctgttttccgagtatgaatctgtgcgttcttctcattccaccagactgtga

SEQ ID NO: 1196 - DNA, 246 bp, Adenovirus D27
  MISC_FEATURE (1)..(246): D27.orf00012 E4 ORF6/7 protein
gtgaccttggactgcgaggcccgcttggatgacttttcagaggacggcttcatctcaatcaccgacccccgtttggctcgccaggaaactgtgtggattatagaccccaagttcagttcccgcactaatcagaacattcccctatttaaggccacccgtgctgagagaattgtttacactgtgaaatgggctggtggtgggagactgactacccgtgctggtgtaaaaatcaataaagatacatga

SEQ ID NO: 1197 - DNA, 1104 bp, Adenovirus D27; identical to SEQ ID NO: 155
  MISC_FEATURE (1)..(1104): D27.orf00014 L5 fiber

SEQ ID NO: 1198 - DNA, 150 bp, Adenovirus D27
  MISC_FEATURE (1)..(150): D27.orf00015 U protein
atgaaaattgtggaccaggaatttgacatccctttcaaggtgtggaggaagtttgccgcccgccggggactggagtatcagagctgggaggagggtactgaggtgctgctgaacaactacaccagagacatactttcagatttcaagtaa

SEQ ID NO: 1199 - DNA, 393 bp, Adenovirus D27
  MISC_FEATURE (1)..(393): D27.orf00016 E3 14.7 kDa protein
atgactgacaaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcatcaaccccatagtcatcacccagcagtcgggcgagaccaacggctgcatccactgctcctgcgaaagccccgagtgcatctactccctgctcaagaccctttgcggactacgcgacctcctccccatgaactga

SEQ ID NO: 1200 - DNA, 387 bp, Adenovirus D27
  MISC_FEATURE (1)..(387): D27.orf00018 E3 RID-beta
atgcagactctgctcatactgctatccctcctataccctgcccttgctgatgattactctaagtgcaaattcgcggacatatggaatttcttagactgctatgatgctaaaatggatatgccttcctattacttggtaattgtggggatagtcatggtctgctcctgcactttctttgccatcatgatctacccctgttttgatcttggctggaactctgttgaggcattcacatacacactagaaagcagttcactagcctccacaccaccacccacaccgcctccccgcagaaatcagtttcccatgattcagtacttagaagagccccctccccggcccccttccactgttagctactttcacataaccggcggcgatgactga

SEQ ID NO: 1201 - DNA, 276 bp, Adenovirus D27
  MISC_FEATURE (1)..(276): D27.orf00019 E3 RID-alpha
atgattcctaggttcttcctatttaacatcctcttctgtctcttcaacatctgtgctgccttcgcggccgtctcgcacgcatcgcccgactgtctcgggcccttcccaacctacctcctctttgccctgctaacctgcacctgcgtctgcagcattgtctgcctggtcatcaccttcctgcagctcatcgactggtgctgcgcgcgctacaattacctacaccacagtcccgaatacagggacgagaacgtagccagaatcttaaggctcatctga

SEQ ID NO: 1202 - DNA, 861 bp, Adenovirus D27
  MISC_FEATURE (1)..(861): D27.orf00021 E3 CR1-gamma
atgaaggctttcacagcttgcgttctgattagcctagtcacacttagtttagccaaaattaatcaaatcagtgtcaaaagaggtgaaaatgttacactagatggaacttatccaaatactacatggacaagatatcaccttacaaaatgggataatatttgcaaatggaatatttcaacatataaatgtcataataatggaagcattacaattcatacttttaatatcacttctggattatacaagggagatagctataaaagagaagtgattacatcaatgtctagatttggaaatatgacagacacttatttcagcgaatatcaacaattaaaaatgtataatttaacaataattgaaccaccaactactaaagcacccactaccactaagcctaccacagttaagacaacacaacctaccactgtgcccactacacatcaaaccaccgcagtcagtacaactattgaaaccactactcacactacacagctagacactacagtgcagaatagtactgtgttggttaggtatctgttgagggaggaaagtactactgaacagacagaggctacctcaagtgccttcagcagcactgcaaatttaacttcgcttgcttcaataaatgagaccctcgtgccgatgaaacaggatcaacctaattactcaggtttggatatgcaaattactttcttaattgtctgtggagtctttattcttgtggttcttctttactttgtcttttgcaaagccagacaaaaatctcatagaacaatctacaggccagtgattggggaacctcagcccctccaagtggacggaggcttaaggaatcttctcttctcttttacagtatggtga

SEQ ID NO: 1203 - DNA, 1266 bp, Adenovirus D27
  MISC_FEATURE (1)..(1266): D27.orf00022 E3 CR1-beta
atgaatactttgaccagtgtcgtgctgctctctcttcttgtagcttttagtcagggacaagctgtgcatgtgaaacttgaaatttgttatggttgtaatggtacactaataggaccacataaaactccagttgagtggtatgacggcagaggacacaaactttgtgcaggatctgatacttttcacaaggaactaaatcacacatgtgatttacaaaatatgacacttacatttgttaacttaactcataagggtacttactatggttttggcagtgataacaaaaactctaaagtataccaggttactattaagccacctgttctgacaactcgcaggcctttattaaaacctgaagatattgtaatcactaagggaagcaacaaaactcttgtgggtcctccagatacaccagttgactggtatgatggttcaggacataaattgtgtaaaggaaaagaagttcattaccctgaactcaatcacacctgtgatgagcagaaccttacactcatatttgtaaatgccacttttaagggaacctattatggctttagaaaagatggcacagacaaaaaggaatatagagtcaaaattgatgatttatatgcaaaacaactaaaacaggaaaaagatgaaaaaccaaggtctggccatgataagcagaaatcaaaaacagaagaaaaacaaaatccaaaaacagaagaaaggcatgggcatagagatgttgttaaagaagttagctttagaactggaactaatcaaactctagtgggcccaccagggtctaaggttgattggcttaaagttggaaatggtgggacatttagcgaactttgtaaaagcgataataaacactattcttgtaattctcaaaacttaacaataatcaatgttaccagatttgatgaaggtagctattatggctctaatgacggttcagctcattacagagtttcagtctacgacccagtacagaaaaaaagggttatgaaaatacaaccacacacaacaaaaactactgcaaaaaaaactacaaaaagcagcactaatgaaacagatgaaaactttgctttgcaacagggtaacaatggggaaaatcaatatgatgaaactaatattccttcaactactgtggcaatcgtggtgggagtgattgcgggcttcataactataatcattgtcattctgtgctacatctgctgccgcaagcgtcccagggcatacaatcatatggtagacccactactcagcttctcttactga

SEQ ID NO: 1204 - DNA, 252 bp, Adenovirus D27
  MISC_FEATURE (1)..(252): D27.orf00024 E3 gp 17.6 kDa protein
atgcagtgtgatatcacacatgacttcaaaaatgaatttgaaaccgaaagtgtgtttgccatcgctaccatggacagtgaccgtgtagttctgctcatctcctggttgccagaagcccacccatacatttcccatggtcttattcttgaatgtaatgttgagagaacatttgtgctcacatttgataactacagagcattcgcttctctcattgcctgtggtgatgttacatcgtggctgttcgtggcatga

SEQ ID NO: 1205 - DNA, 192 bp, Adenovirus D27
  MISC_FEATURE (1)..(192): D27.orf00025 E3 gp 17.6 kDa protein
atgtgtgatatcacactgcatgtggctagacttcatggcttgtggccccctaccaaggagaacatggtgggtttttctttggcttttgtgatcatggcctgcttgatgtcaggtctgctggtaggggctttagtgtggttcctgaagcgcaagcctaggtatggaaatgaggagaaggaaaaattgctataa

SEQ ID NO: 1206 - DNA, 567 bp, Adenovirus D27
  MISC_FEATURE (1)..(567): D27.orf00026 E3 CR1-alpha
gtgagtttaataaaagctgaactaagaacctactttggaatcccttgtcgtcatcctcggaacaagaccgtcttctttaccaaccagaccaaggttcgtctgaactgcacaaccaacaggaagtaccttctctggacttttcaagacacctcactcgctgttgtcaatacccgtgacaacgacggtgttttaatccccaacaacctcaccagtggacttactttctctaccaacaaaacaaagctcatccttcaccacccttttgtagagggaacctaccagtgccgacacggaccttgtgttcacaacttccatttggtgaaccttaccagcagcagcacagttgctcctgaaagtaacctttcttctgatactaacaaacctcgtgtcggaggtgagctttgggttccatctctaacagagggtgggagttctattgaagtggttgggtatttgattttaggggtggtccttggtgggtgcatagcagtgctgtatcaacttccttgctgggtcgaaatcagggtatttatctgctgggtcagacattgtggggaggaaccatga

SEQ ID NO: 1207 - DNA, 321 bp, Adenovirus D27
  MISC_FEATURE (1)..(321): D27.orf00027 E3 12.2 kDa protein
atgtcctatggtgactcggctgagctcgctcggttgaggcatctggaccactgccgccgcctgcgctgcttcgcccgggagagctgtggcctcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgctgtactctttgtggtgagtttaataaaagctga

SEQ ID NO: 1208 - DNA, 684 bp, Adenovirus D27
  MISC_FEATURE (1)..(684): D27.orf00029 L4 pVIII
atgagcaaggagattcccaccccttacatgtggagctatcagccccagatgggcctggccgcgggcgcctcccaagactactccacccgcatgaactggctcagtgccggcccctcgatgatatcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactga

SEQ ID NO: 1209 - DNA, 219 bp, Adenovirus D27; identical to SEQ ID NO: 912
  MISC_FEATURE (1)..(219): D27.orf00030 L4 20 kDa protein

SEQ ID NO: 1210 - DNA, 186 bp, Adenovirus D27; identical to SEQ ID NO: 949
  MISC_FEATURE (1)..(186): D27.orf00032 L4 22 kDa protein

SEQ ID NO: 1211 - DNA, 2199 bp, Adenovirus D27
  MISC_FEATURE (1)..(2199): D27.orf00034 L4 100 kDa protein
atggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctcaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacatgcgagcccaacccgcgtctcaacttctatcccgtctttgcggtccccgaggccctcgccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggtgacaacgccaggctggccgtgctcaagcgcagcgtcgagctcacccactttgcctaccccgccgtcaacctcccgcccaaggtcatgcgtcgcatcatggatcagctcatcatgccccacatcgaggccctcgatgagacccaagagcagcgccccgaggacgcccggcccgtggtcagcgacgagatgctcgcgcgctggctcgggacccgcgagccccaggctttggaacagcggcgcaagctcatgctggccgtggtcctggtcaccctcgagctcgaatgcatgcgccgcttcttcagcgaccccgagaccctgcgcaaggtcgaggagaccctgcactacactttcagacacggtttcgtcaggcaggcctgcaagatttccaacgtggagctgaccaacctggtctcctgcctggggatcctgcatgagaaccgcctgggacagaccgtgctccactctaccctgaagggcgaggcgcggagggactatgtccgcgactgcgtctttctctttctctgccacacatggcaagcagccatgggcgtgtggcagcagtgtctcgaggacgagaatctgaaggagctggacaagcttcttgctagaaaccttaaaaagctttggacgggcttcgacgagcgcaccgtcgcctcggacctggccgagatcgtcttccccgagcgcctgaggcagacgctgaaaggcgggctgcccgacttcatgagccagagcatgttgcaaaactaccgcactttcattctcgagcgatcggggatgctgcccgccacctgcaacgctttcccctccgactttgtcccgctgagctaccgcgagtgtcccccgccgctgtggagccactgctacctcttgcagctggccaactacatcgcctaccactcggacgtgatcgaggacgtgagcggcgaggggcttctcgagtgccactgccgctgcaacctgtgctccccgcaccgctccctggtctgcaacccccagctccttagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgcagctccggtcaagcctcctcgtag

SEQ ID NO: 1212 - DNA, 1470 bp, Adenovirus D27
  MISC_FEATURE (1)..(1470): D27.orf00035 E2A DNA-binding protein
atggccggcggcagtcaggacgtgcgccggttcatggaccgagaggccactccgccccggggccacggttcagcgcgctatccgccggagcaggagaggagcccctcgccgccacctcctctgccaaccaagcgccgaaagtatcagcgggtgggatccgggtcttccgaggaggacgtggtccccgtggacagccctccaaaaaagaagcaagccagaaagaccaagcatgtgaccaaggtagacccagacgaagagatgccccaggaagaagccgtgatcgtgggagtgggattcagccagccgccggttctgttgaaggaaggcaaggacggaaaacgcatcgtcgagcccgcgacccccggtgtcctgaacgtgcgcaaccccctgagtctgcctctggtctcgtcctgggagaagggcatggataccatgaacgtgctgatggaacgctaccgcgtcgacagcggcctgcgcgatgcttacaagctcatgcccgagcagaccgagatcttccaaaagatgtgccagacctggatgaacgaggaggcccgcggtctgcaactgaccttcaccacccagaaagcatttagcaccgtcatgggtcgcctgttgcaaggttacattttcagccacagcgggatcgcgcacaagaattgggagtgcaccggctgcgccctgtgggatcacggctgcaccgaggtggaaggccagctcaagtgtctgcatggaacggtgatgatccacaaggaccacgtggtggagatggatgtgaccagtgagaacggacagcgcgcgctgaaggagcaacccagcaaggccaaggtgacccagaaccgctggggacggagcgtggtgcaactgaccagccatgacgcgcgctgctgcgtccatgatgccgggtgcgggaataatcagttcagcgggaagagctgcggcctgtttttcagcgagggggccaaggcccagcaagctttcaagcagatcgcggccttcgtcaaggccctctacccgaatatgcagcgcggcgcggggatgatgctgatgcccgtgcactgcgagtgtaaccacaagcctcagagcgtgcccttcctgggccgccagctgtgcaagatgaccccgttcggcctgagcaacgccgaggacctggacaaggatcagatcagcgacaagagcgtgctggctagtgtgaagtaccccagtctgatggtgttccagtgctgcaacccagtgtaccgcaactcgcgcgcgcagagcaccggccccaactgcgatttcaagatctccgcgcctgacatgctgggcgccctgcagatgagccggcgcatgtggagcgagaccttccccgagaccccagtgcccaaactggtgatccccgagttcaagtggcagcccaagtaccagttccgcaacgtggccctccccagcgcggcgcacaacgacgagcgcgagaaccccttcgacttttaa

SEQ ID NO: 1213 - DNA, 630 bp, Adenovirus D27
  MISC_FEATURE (1)..(630): D27.orf00037 L3 23.6 kDa protease
atgagcggctccagcgaaagagagctcgcggccatcgtgcgcgacctgggctgcgggccctactttttgggtacccacgacaagcgcttcccgggcttccttgccggcgacaagctggcctgcgccatcgtcaacacggccggccgcgagaccgggggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctccggcgcaaccaggaggagctctaccgcttcctcgcgcgccactccccttactttcgctcccaccgcgccgccatcgaacacgccaccgcttttgacaaaatgaaacaactgcgtgtatctcaataa

SEQ ID NO: 1214 - DNA, 2841 bp, Adenovirus D27; identical to SEQ ID NO: 215
  MISC_FEATURE (1)..(2841): D27.orf00039 L3 hexon

SEQ ID NO: 1215 - DNA, 651 bp, Adenovirus D27
  MISC_FEATURE (1)..(651): D27.orf00040 L3 pVI
atgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctctggcattaacggggtggtggacatcgcgaaccaggccgtgcagcgcgagataaacagccgcctggacccgcgcccgcccacggtggtggagatggaagatgcaactcttccgccgcccaaaggcgagaagcggccgcggcccgacgcggaggagacgatcctgcaggtggacgagccgccctcgtacgaggaggccgtgaaggccggcatgcccaccacgcgcatcatcgcgccgctggccacgggtgtaatgaaacccgccacccttgacctgcctccaccacccacgcccgctccaccaaaggcagctccggttgtgcagccccctcctgtggcgaccgccgtgcgccgcgtccccgcccgccgccaggcccagaactggcagagcacgctgcacagtatcgtgggcctgggagtgaaaagtctgaagcgccgccgatgctattga

SEQ ID NO: 1216 - DNA, 1005 bp, Adenovirus D27
  MISC_FEATURE (1)..(1005): D27.orf00042 L2 pV
atgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgagagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatagaggtgcagaccgacccctggctcccagcctccaccgctaccgtctccacttctaccgccgccacggctaccgagcctcccaggaggcgaagatggggcgccgccagccggctgatgcccaactacgtgttgcatccttccattatcccaacgcctggctaccgcggcacccggtactacgccagccgcaggcacccagccaccaagcgccgccgccgcaccaccacccgccgccgtctggccccagcccgcgtgcgccgcgtgaccacgcgccggggccgctcgctcgttctgcccaccgtgcgctaccaccccagcatcctttaa

SEQ ID NO: 1217 - DNA, 585 bp, Adenovirus D27
  MISC_FEATURE (1)..(585): D27.orf00043 L2 pVII major core protein L2 pVII
atgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgtcatcgactcggtggtcgccgacgcgcgcaactacactcccgccccctccaccgtggacgcggtcatcgacagcgtggtggccgacgcgcgcgactatgccagacgcaagagccggcggcgacggatcgccaggcgccaccggagtacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctga

SEQ ID NO: 1218 - DNA, 1545 bp, Adenovirus D27; identical to SEQ ID NO: 185
  MISC_FEATURE (1)..(1545): D27.orf00044 L2 penton

SEQ ID NO: 1219 - DNA, 1683 bp, Adenovirus D27
  MISC_FEATURE (1)..(1683): D27.orf00047 L1 pIIIa
atgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcgaaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccggactactttttccagacgagccggcagggcttgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagccgcgcgctggggcagaacgacaccgacagtctgagggccaccctgaacttcttgctgaccaatagacagcagaagatcccggcgcagtacgcactgtcggccgaggaggaaaggatcctgagatatgtgcagcagagcgtagggctgttcctgatgcaggagggcgccacccccagcgccgcgctggacatgaccgcgcgcaacatggaacctagcatgtatgccgccaaccggccgttcatcaataagctgatggactacctgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacttttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccacgggccaagaacgccatggccaataacgggatagagagtctggtggacaaactgaaccgatggaagacctacgctcaggaccatagggacgcgcctgcgccgcggcgacagcgccacgaccggcaacggggcctggtgtgggacgacgaggactcggccgacgataacagcgtgttggacttgggcgggagcggtggggccaacccgttcgcgcatctgcagcccagactggggaggcggatgttttga

SEQ ID NO: 1220 - DNA, 1119 bp, Adenovirus D27
  MISC_FEATURE (1)..(1119): D27.orf00050 L1 52 kDa protein
atgcatcccgtcctgcgccaaatgcgtcccacccccccggcgaccaccgcgaccgcggccgtagcaggcgccggcgctagccagccacagacagagatggacttggaagagggcgaagggctggcaagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgaacagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcactgctgaacatcgccgagcccgagggtcgctggctgctggagctgatcaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctaagcgaccgcgagctgatgctgagccttcgccgggcgctggtagggggcgccgccggcggcgaggagtcctacttcgacatgggggcggacctgcattggcagccgagccggcgcgccttggaggccgcctacggtccagaggacttggatgaggatgaggaagaggaggaggatgcacccgctgcggggtactga

SEQ ID NO: 1221 - DNA, 1854 bp, Adenovirus D27
  MISC_FEATURE (1)..(1854): D27.orf00052 pTP
atggactatttcctgccgctgcgcaacatctggaaccgcgtccgcgagttcccgcgcgcctccaccaccgccgccggcatcacctggatgtcccgctacctctacggctaccaccgcctcatgctcgaggacctggccccgggcgcgccggccacccagcgctggccgctctaccgccagccgccaccgcacttcctagtcggctaccagtacctcgtgcgcacctgcaacgactacgtcttcgactcgcgcgccttctcgcggatcaggtactccgaggtcgtgcaacccggcctgcagaccgtcaactggtcgctcatggccaactgcacctacaccatcaacaccggggcctaccaccgcttcgtcgacatggatgacttccaggacaccctcacccgcgtgcaacaggccatcctcgccgagcgcgtcgtcgccgacctggcgctcgtgcagccgctcaggggcgtcggggtcacccgcatggaagactccgcctccgccagtgatgacattgagaggctcatgcatgactactacaagaacctgagccggtgtcagggccaggcctggggcatggccgagcggctccgcatccagcaagcgggacccaaggacctggtcctcctcgccaccatccgccgcctcaaaaacgcctacttcaattacatcatcagcaaccgcaattctaacagcgtccacagggctgctacgtgtttgagcttaccttgcgactgcgattggctagacgctttcctcgaaagattctccgatccggtcgatctcgacgcgctcacgtcccctacaccgcaattgataagatgcatcgtcagcgccctatcgctgcccaatggggacccgccccattaccgggagatgaccggcggcgtcttcacgctgcgtcctcgcgaacggggtcgcgccgtcaccgaaaccatgcgtcgccgccgcggggagatgatcgagcgcttcgtcgaccgtctcccggtgcgtcgccgtcgtcgtcgggccccgccaccaccaccgcccccagaggaagaaatagaagaagaggtcgtcatggaagaagaggaagaagaggaggcccccggggatttcgagcgcgaggtgcgcgccaccatcgccgagctcatcaggctcctggaagacgagctcacggtctcggcccgcaatgcccagtttttcaacttcgccgtggatttctacgaggccatggaaaggctggaggccatcggcgacatcagcgagatgcccctgcgccgctggatcatgtacttcttcgtcaccgagcacatcgccaccaccctcaactacctcttccagcgcctgcgcaactacgccgtcttcacgcggcacgtggagctcaacctcgcgcaggtggtcatgcgcgcacgcgacgccgacggggacgtggtctacagccgcgtctggaacgagagcggcctgggcgccttctcgcagctcatgggccgcatctccaatgacctcgccgccaccgtggagcgcgcgggccgcggcgatctccaggaggaggagatcgaacagttcatgtccgagatcgcctaccaggacaactcgggcgacgtgcaagagatcctgcgtcaggccgccgtcaatgacgcagagattgattctgttgaactgtctttcaggttcaaagtcacggggcccgtggtcttcacgcagaggcggcagatccaggatgtcaaccgccgcgtcgtcgcgcacgccagcgctctcagggcgcagcaccgggacctgcccgagcgccacgccgacgtgcctctgccgcccctgcccgcggggccggaaccgccgctgccgccgggagcgcgtccgcgacaccgcttctaa

SEQ ID NO: 1222 - DNA, 3276 bp, Adenovirus D27
  MISC_FEATURE (1)..(3276): D27.orf00055 E2B DNA polymerase
atgcaatgcgtggacacgaccaccaactcacccgtagagatcaagtaccatctgcatctcaagcacgccctcacccgcctctacgaggtcaacctcagaaccctgcccccggacctggatctccgcgacaccatggacagctcccaactgcgcgccctcgtcttcgctctccgcccccgccgcgccgatatctggacctggctcccgcgcgggctcgtcagcctctccgtcctcgaggagccccagggtgagtcccacgcaggcgaacatgaaagccaccagccagggccgccactcctgaagttcctcctcaagggacgcgctgtgtatctcgtggatgaggtacagcccgtgcagcgctgcgagtactgcggacgcttttacaagcatcagcacgagtgctcggttcgccggcgggatttctactttcatcacatcaacagccactcgtccaactggtggcaggaaatccagttcttcccaatcggctctcatcctcgcacggagcggctctttgtcacctacgatgtagaaacctacacctggatggggtccttcggcaagcagctcgtccccttcatgctggtcatgaaattctcgggggaacccgagctggtcgccctcgctcgcgatctcgccgtgcgcttacgctgggatcgctgggagcgggaccccctcaccttctactgcgtcaccccagaaaagatggccgtgggccagcagttccgcctctttcgcgacgagctccagaccctcatggcccgcgagctctgggcttccttcatgcaagccaacccacatctccaggagtgggcgctcgagcagcacggcctgcaatgccccgaggacctcacctacgaggagctcaaaaagctgccgcacatcaaaggccgcccgcgattcatggaactctacatcgtcgggcacaacatcaacggcttcgacgagatcgtccttgccgcccaggtgatcaacaaccgagcctccgtcccgggccctttccgcatcacccgcaatttcatgccgcgggcaggcaagattctcttcaatgacgtcactttcgctctgcctaaccccctctcaaagaagcgcaccgatttcgagctctgggagcacggcggctgcgacgactcggatttcaagtaccagttcttgaaagtcatggtcagggacacctttgccctgacgcacacctcgctccgcaaggccgctcaagcttacgccctccccgtggagaagggctgctgtccctacaaggccgtgaaccatttctacatgctgggctcttaccgtgcggacgatcgaggattcccgctccgggagtactggaaggatgacgaggaatacgccctcaaccgcgagctgtgggagaagaaaggagaggcgagttatgacatcatccgcgaaacgctggactactgcgccatggacgtcctcgtcaccgccgagctcgtcgccaagctgcaagactcctacgcgcacttcatccgcgactcggtccgcctgccccacgcccactttaacatcttccaacggcccaccatctcctccaactcgcatgccatctttcgccagatcgtcttccgcgccgagcagccccagcgcaccaatctcggccccgccttcttggccccctcgcatgagttgtatgactacgtgcgcgccagcatccgcggggggcgctgttatcccacctacatcggcatcctctcggagcccatctatgtctatgacatctgcggcatgtacgcctccgccctcacgcatcccatgccctggggtccgccccttaacccctacgagcgagcgctggccgcccgcgagtggcagatggccttggatgatgcatcctcaaaaatagattattttgacaaggaactctgtccgggcatcttcaccatcgatgcggacccccctgacgagcatctgcttgatgtgctgccaccgttctgctcgcgcaagggcggcagactctgctggaccaacgagcccctgcgcggcgaggtggccaccagcgtggacctggtcaccctgcataaccgcggctggcgcgtcaggatcgtgcccgacgagcgcaccaccgtcttcccggaatggaagtgcgtcgcgcgcgagtatgtccagctcaacatcgcggccaaggagcgcgccgaccgtgacaaaaatcagacaatgagatccatcgccaagcttctctccaacgccctctatggctccttcgccaccaagcttgacaataaaaaaattgtcttttctgaccagatggatgaaagtctcctaaaaagcatcgcggcagggcaggccaacatcaaatcctcctcgtttctagaaactgacaacctgagtgccgaggtcatgcccgctctcgagagggaatacctaccccaacagctggcgctcgtggacagcgacgcggaagagagtgaggacgagcacagacccgcccccttttatacccccccgtcggggacccccggtcacgtggcctacacctacaagccaatcaccttcttggatgcggaggagggggacatgtgtctgcacacggtggaaaaggtggaccccctggtggacaacgaccgctacccctcgcacgtggcctcctttgtcttggcgtggacgcgcgcctttgtctcagagtggtccgagtttctctacgaggaggaccgcgggacgcccctgcaggacaggccaatcaagtccgtctacggggacaccgacagcctgtttgtcaccgagcgcggacacagactcatggagacgcgaggtaagaagcgcatcaaaaagaacgggggaaaactggtttttgaccccgagcagccagagctcacctggctcgtcgagtgcgagaccgtctgcgcccactgcggagcggacgctttcgctcccgagtccgtctttctcgcccccaagctctacgccctgcaatccctcctctgtcccgcctgcgggcgctcttccaagggcaagctccgcgccaagggccacgccgccgaggccctcaactacgagctcatggtcaactgctatctcgccgactcgcagggcgaagaccgtgcccgtttcagcaccagcaggatgagtctcaagcgcacccttgcaagcgcccagccaggggcccaccccttcaccgtgacggagaccaccctcactcggaccctgagaccctggaaggacatgacgctggccgcgctggacgcccatcgtctcgtgccctacagtcgcagtcgtcccaacccccgaaacgaggaagtctgctggatcgagatgccgtag

SEQ ID NO: 1223 - DNA, 1047 bp, Adenovirus D27; identical to SEQ ID NO: 927
  MISC_FEATURE (1)..(1047): D27.orf00056 pIVa2 protein

SEQ ID NO: 1224 - DNA, 405 bp, Adenovirus D27; identical to SEQ ID NO: 928
  MISC_FEATURE (1)..(405): D27.orf00058 pIX protein

SEQ ID NO: 1225 - DNA, 1488 bp, Adenovirus D27; identical to SEQ ID NO: 929
  MISC_FEATURE (1)..(1488): D27.orf00060 E1B 55k E1B 55k protein

SEQ ID NO: 1226 - DNA, 207 bp, Adenovirus D27; identical to SEQ ID NO: 966
  MISC_FEATURE (1)..(207): D27.orf00063 E1A 14.8 kDa protein

SEQ ID NO: 1227 - DNA, 573 bp, Adenovirus D27
  MISC_FEATURE (1)..(573): D27.orf00065 E1A 28 kDa protein
atgagacacctgcgcctcctgccttcaactgtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaggaggctgtgaatttaatatttccagaatctatgattcttcaggctgacatagccaacgaatctactccacttcatacaccgactctgtcacccatacctgaattggaagaggaggacgaactagacctccggtgttatgaggaaggttttcctcccagcgattcagaggatgaacggggtgagcagaccatggctctgatctcagactatgcttgtgtgattgtggaggaacaagtagtgattgaaaattctaccgagccagtggagggctgtagaaaatgccagtaccaccgggataagtctggagacccgaacgcatcatgcgctttgtgctatatgaaacagactttcagctttatttacagtaagtggagtgaatgtgagagaggctga

SEQ ID NO: 1228 - DNA, 126 bp, Artificial Sequence; identical to SEQ ID NO: 932
  D27.orf00066 hypothetical protein

SEQ ID NO: 1229 - DNA, 378 bp, Adenovirus D33
  MISC_FEATURE (1)..(378): D33.orf00002 E4 ORF1 protein
atggctgaatctctgtatgcttttatagatagccctggagggatcgctcccgttcaggaagggtttagcaatagatataatttcttttgccccgaatcttttcacattcctccgcatggggtggttttggttcacctaagagtgagcgtgctaattcctactggctaccaaggcagatttttggccttaaatgactaccatgccaggggcatactaacccagtccgatgtgatttttgccgggagaagacatgagctaactgtgctgctctttaaccacacggaccgatttttgtatgtccgcgagggccacccagtgggcacactgttgctggagagagtgatttttccttcagtgagacttgccactctggtttag

SEQ ID NO: 1230 - DNA, 393 bp, Adenovirus D33
  MISC_FEATURE (1)..(393): D33.orf00003 E4 ORF2 protein
atgcttgagcgacacgctgtcagctaccacattgtggttcctggggtcctagtgacttatttagaggacttttctattactcaaatgattaaagaaaaactacctcgctttatcactcacctcttggaaggcatcaccggtgacacaaagagagcttattccagcatgcagtttttgggcgctagctttggagcattaaagtactcactcacgcttgccagtcccacgcttagccctggctctgaattgtcagctgtagtggctgaggacttgagtgactttttgcagctgacgctgagacgtgagctgagggcagagggcagaacctcattgaatcttgttgttttgaacacgctgcaggtggtggagcagcaggatctgtttctaatatga

SEQ ID NO: 1231 - DNA, 354 bp, Adenovirus D33
  MISC_FEATURE (1)..(354): D33.orf00005 E4 ORF3 protein
atgaaggtctgcctgattatgaaagtggagggggcgctgtgggaacttttccacatgtgcggagtggacttacaccaacaatttgtagaaataattcaaggctggaaaaatgagaattacctgggaatggtgaatgagtgtaacctgatgattgatgaaatcgatggaggcccagcctttaatgtgattcttatgctggatgtacgcgtagagccactgctcgaagctacagtcgagcaccttgaaaatagagtgggttttgacctggctgtctgtttccaccagcacagcggcggggaacgctgtcacctgcgtgacttgcactttatcgtccttcgagaccgcttggaataa

SEQ ID NO: 1232 - DNA, 663 bp, Adenovirus D33
  MISC_FEATURE (1)..(663): D33.orf00008 E4 34 kDa protein
atgatcctgaccccagaggaaataaaaattttaaaaagatgtatgtcagtgtgcctgtgccccgctaccctggacttggtgagagctcagatggtgagcgggtacgagcgctggatcctgcattgccactgttcatccccgggctccctgcagtgtcgggcgggaggcaccctgctggccgtgtggttcaggagagtcatttacgggtgcatgttcaaccagcgcttcccatggtaccgccagattgtgaacagagacatgcccaaagagatcatgtatatgggcagtgtgttcatgaggggcaggcacctgatatactgccgcatctggtacgatggtcacgtgggttccatcatccccaacatgagctttggctggagcgccctgaattatgggctgctgaataacatggtgattatgtgctgcacttactgtgagaacatggcagagatcaggatgcggtgctgtgcccgacgcaccaggagactgatgctgaaggctgttgggattatagtcagagagacttgcgatcccgatcccatctgcagcagccgcaccgagccccggcggcagagactgctgagggcgctgatggagaggcacagacccatcctgttttccgagtatgaatctgtgcgttcttctcgttccaccagactgtga

SEQ ID NO: 1233 - DNA, 246 bp, Adenovirus D33
  MISC_FEATURE (1)..(246): D33.orf00010 E4 ORF6/7 protein
gtgaccttggactgtgaggcccgcttggatgacttttcagaggacggcttcatctcaatcaccgacccccgtttggctcgccaggaaactgtgtggattatagaccccaagtccagttcccgcactaatcagaacatttccctatttaaggccacccgtgctgagagaattgtttacactgtgaaatgggctggtggtgggagactgactacccgtgctggtgtaaaaatcaataaagatacatga

SEQ ID NO: 1234 - DNA, 1149 bp, Adenovirus D33; identical to SEQ ID NO: 156
  MISC_FEATURE (1)..(1149): D33.orf00011 L5 fiber

SEQ ID NO: 1235 - DNA, 150 bp, Adenovirus D33
  MISC_FEATURE (1)..(150): D33.orf00012 U protein
atgaaaattgtggaccaggaatttgacatccctttcaaggtgtggaggaagttcgccgcccgccggggactggagtaccagagctgggaggagggtaccgaggtgctgctcaacaactacaccagagacatactttcagatttcaagtaa

SEQ ID NO: 1236 - DNA, 390 bp, Adenovirus D33
  MISC_FEATURE (1)..(390): D33.orf00013 E3 14.6 kDa protein
atgactgaccacctggacctcgagatggacggccaggcctccgagcagcgcatcctgcaactgcgcgtccgacagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcacctatgagatgccccagcagaagcagaaattcacctgcatggtgggcgtcaaccccatagtcatcacccagcagtcgggcgagaccaacggctgcatccactgctcctgcgaaagccccgagtgcatctactccctcctcaagaccctttgcggactccgcgacctcctccccatgaactga

SEQ ID NO: 1237 - DNA, 123 bp, Adenovirus D33
  MISC_FEATURE (1)..(123): D33.orf00015 E3 RID-beta
atggaatttcttagactgctatcaggagaaaatggatatgccttcctattacttggcgattgttggggtagtcatggtctgctcctgcactttctttgccattatgatctacccatgttttaa

SEQ ID NO: 1238 - DNA, 276 bp, Adenovirus D33
  MISC_FEATURE (1)..(276): D33.orf00016 E3 10.4 K E3 ORF 4 10.4 kDa protein
atgattcctaggttcttcctatttaacatcctcttctgtctcttcaacatctgcgctgccttcgcagccgtctcgcacgcctcacccgactgtctcgggcccttccccacctacctcctctttgccctgctcacctgcacctgcgtctgcagcattgtctgcgtggtcatcaccttcctgcagctcatcgactggtgctgcgcgcgctacaattacctacaccacagtcccgaatacagggacgaaaacgtagccagaatcttaaggctcatatga

SEQ ID NO: 1239 - DNA, 813 bp, Adenovirus D33
  MISC_FEATURE (1)..(813): D33.orf00018 E3 CR1-gamma
atgaaggctttcacagcttgcgttctgattagcatagtcacacttagtgcagctgctggtaaatgctatcatacagttaatgtcactaggggagggaatattacacttacaggggcaggaatcaacactacatggacagcttatcataacgatggaaaggggcaaaatggttggttgcccatctgtacatggggcgatcccatctatgtgtgccatggaaatagcagtactatttccaatcttacagttgtagctcacaaaaatctaactgacagaactattaaggcatatagctatgagaacaaagatgattatgaaacagtaaattcatgcttttatgttgtaaaagttgttgagcttccaaccactaaagcgcccacacagtctactacacatccaaccaccacagccagtacaactactgagaccactactcaaactacacagctagacactacagtgcagaatagtactgtgttggttaggtatttgttaagggaggaaagtactactgaacagacagaggctacctcaagtgccttcagcagcactgcaaatttaacttcgcttgcttcggtaaatgagacgatcgtgccgatgatgtatggccaacattacccaggtttggatatacaaattactttcctgattgtctgtggggtctttatcctcgctgtccttctctactttgtctgctgcaaggccagagaaaaatctaggcggcccatctacaggccagtaatcggggaacctcagccactccaagtggatggaggcttaaggaatcttctcttctcttttacagtatggtga

SEQ ID NO: 1240 - DNA, 1224 bp, Adenovirus D33
  MISC_FEATURE (1)..(1224): D33.orf00019 E3 CR1-beta
atgaatactttgaccagtgtcgtgctgctctctcttcttgtggttcttagtcagggacaaatagaacatgaaaaacagagtgttcagtggggaaagaacataacgcttgtgggtcctaatgataaacctgttgaatggcacggacctagagatcaactttgtaagggaaaacaaatcttacacccagaattcaatcacacatgtaatgaacaaaacctcacactactttttgtgaataacactttccagggaatatattatggcattagaaatgatggtagaggtatgaaacaaattcaactaacagttgttgcacctcctgcctccacacgaaaacctttgtcaaagccaaaacaagtgaatgtccaatatggacataatgtaacattagaaggtcctccaggaatacctattgactggctcggaccaactaatcagctttgtaaaggaaaagaaattttacacccagaaataaaccatacctgtaatgttcaaaatttaacacttttatttgtaaactatactcaccgtggagcatattttggctttaacaaagacggaactgacagacatcactatgaggttactattctagatgggttcacaaatgcagggcagacaaaagaagagtcagtcagtgacaaatcaaaaggaaaaacttcttcaaaagagaaaaaaactcaaaaaaataactctcagagaaatgatgatgttaaagagttagattttcccagtggatctaatcaaactttagttggcccccctggatcaaaagttgattggtacacaacaaaaaatggtgactttacaaaattgtgtgatggattaaatggaccaaaaaatctgtgtaattatcagaacttaacattgcgaaatgtaagcagacaggacgaaggaacttattttgggtctaacgaacagtcaaagcattacagagttactgtctatacaaaacctagaaatcaaactaagagaatccagccatatactactaaaggaactacaaaatcaaccttaggtaatcacagctttgaattgcaactggcagatgatcaatctaatcaacaggatcaacaaattccatcaactactgtggcaatcgtggtgggagtgattgcgggctttataactataatcattgtcattctgtgctacatctgctgccgcaagcgtcccaggtcatacaatcatatggtagacccactactcagcttctcttactga

SEQ ID NO: 1241 - DNA, 252 bp, Adenovirus D33
  MISC_FEATURE (1)..(252): D33.orf00021 E3 gp 17.6 kDa protein
atgcagtgtgatatcacacatgacttcaaaaatgaatttgaaaccgaaagtgtgattgccatcgctaccatggacagtgaccgtgtagttctgctcatctcctggttgccagaagcccacccatacatgtcccatggtcttattcttgaatgtaatgttgagagaacatttgtgctcacatttgataactacagagcattcgcttctctcattgcctgtggtgatgttacatcgtggctgttcgtggcatga

SEQ ID NO: 1242 - DNA, 192 bp, Adenovirus D33
  MISC_FEATURE (1)..(192): D33.orf00022 E3 gp 17.6 kDa protein
atgtgtgatatcacactgcatgtggctagacttcatggcttgtggccccctaccaaggagaacatggtgggtttttctttggcttttgtgatcatggcctgcttgatgtcaggtctgctggtaggggctctagtgtggttcctaaagcgcaagcccaggtacggaaatgaagagaaggaaaaattgctataa

SEQ ID NO: 1243 - DNA, 594 bp, Adenovirus D33
  MISC_FEATURE (1)..(594): D33.orf00023 E3 CR1-alpha
atgagaatttttgctgtactctttgtggtgagtttaataaaagctgaactaagaacctactttggaatcccttgtcgtcatcctcggaacaagaccgtcttctttaccaaccagaccaaggttcgtctgaactgtacaaccaacaggaagtaccttctctggactttccaagacacctcactcgctgttgtcaatacccgtgacaacgacggtgttttaatccccaacaacctcaccagtggacttactttctctaccaacaaaacaaagctcatccttcaccacccttttgtagagggaacctaccagtgccgacacggaccttgtgttcacaacttccatttggtgaaccttaccagcagcagcacagttgctcctgaaactaacctttcttctgatactaacaaacctcgtgtcggaggtgagctttgggttccatctctaacagagggtgggagttctattgaagtggttgggtatttgattttaggggtggtccttggtgggtgcatagcagtgctgtatcaacttccttgctgggtcgaaatcagggtatttatctgctgggtcagacattgtggggaggaaccatga

SEQ ID NO: 1244 - DNA, 321 bp, Adenovirus D33
  MISC_FEATURE (1)..(321): D33.orf00024 E3 12.2 K E3 12.2 kDa protein
atgtcccatggtgactcggctgagctcgctcggttgaggcatctggaccactgccgccgcctgcgctgcttcgcccgggagagctgcggcctcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgctgtactctttgtggtgagtttaataaaagctga

SEQ ID NO: 1245 - DNA, 684 bp, Adenovirus D33
  MISC_FEATURE (1)..(684): D33.orf00025 L4 pVIII
atgagcaaggagattcccaccccttacatgtggagctatcagccccagatgggcctggccgcgggcgcctcccaggactactccacccgcatgaattggctaagtgccggcccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgttccgcccacaaccgggtataaaaaccctggtgatccgaggcagaggcacacagctcaacgacgagttggtgagctcttcgatcggtctgcgaccggacggagtgttccaactagccggagctgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaatcggtggacggctacgactga

SEQ ID NO: 1246 - DNA, 219 bp, Adenovirus D33; identical to SEQ ID NO: 912
  MISC_FEATURE (1)..(219): D33.orf00026 L4 20 kDa protein

SEQ ID NO: 1247 - DNA, 186 bp, Adenovirus D33
  MISC_FEATURE (1)..(186): D33.orf00029 L4 22 kDa protein
gtgaagggtgacggtaagcacgagcggcagggctaccgatcatggaggacccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaa

SEQ ID NO: 1248 - DNA, 2193 bp, Adenovirus D33
  MISC_FEATURE (1)..(2193): D33.orf00031 L4 100 kDa protein
atggaggagcagccgcgtaagcaggagcaggaggaggagaacttaaccacccacgaacaagcaaaaatcgagcaggacctgggcttcgaagagccggctcgtctagaacccccacaggatgaacaggagcacgagcaagacgcaggccaggaggagaccgacgctgggctcgagcatggctacctagaggaggacatgctgctgaaacacttgcagcgccaatccctcatcctcagggacgccctggccgaccggagcgagacccccctcagcgtcgaggagctaagtagggcctacgagctcaaccttttctcgccgcgcgtgccccccaaacgccagcccaacggcacctgcgagcccaacccgcgcctcaacttttaccccgttttcgcggtccccgaggccctggccacctatcacatctttttcaagaaccaaaagatccccgtctcctgtcgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcaaactagcgccctggtagagttggaaggcgacaacgccaggctggccgtactcaagcgcagcgtcgagctcacccacttcgcctaccccgccgttaacctcccgcccaaggtcatgcgtcgcatcatggatcagctcatcatgccccacatcgaggccctcgatgagacgcaagagcagcggcccgaggacgcccagcccgtggtcagcgacgagcagctcgcgcgctggctcgaaaaccgcgacccccaggtcctggagcagcggcgcaagctcatgctggccgtggtccttgttaccctcgagctggaatgcatgcgccgcttcttcagcgaccccgacaccctgcgcaaggtcgaggagacactgcactacactttcaggcacggctttgtcaggcaggcctgcaagatctccaacgttgagctgaccaacctggtctcctgcctggggatcctgcacgagaaccgcctggggcagaccgtgcttcactctaccctcaagggagaggcgcgtcgggactacatccgcgactgcgtctttctctttctttgccacacctggcagtcggccatgggagtgtggcagcagtgtctagaggacgagaacctgaaggagctggacaagcttcttgctagaaacctcaaaaagctgtggacgggcttcgacgagcgcaccgtcgcctcggacctggccgaaatagtcttccccgagcgcctgaggcagacgctgaaaggcgggctgcccgacttcatgagccaaagcatgttgcaaaactaccgcactttcattctcgagcgatcggggatcctgcccgccacctgcaacgccttcccctccgactttgtcccgctgagctaccgcgagtgtcccccgccgctgtggagccactgctacctcttgcagctggccaactacatcgcccaccactcggatgtgatcgaggacgtgagcggcgaggggctgctagagtgccactgccgctgcaacctgtgctccccgcaccgctccctggtctgcaacccacagctcctcagcgagacccaggtcatcggtaccttcgagctgcaaggtccggagaagtccaccgctccgctgaaactcacgccggggttgtggacttccgcgtacctgcgcaaatttgtacccgctgactaccacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgctccggtcaagcctcctcgtag

SEQ ID NO: 1249 - DNA, 1470 bp, Adenovirus D33
  MISC_FEATURE (1)..(1470): D33.orf00032 E2A DNA-binding protein
atggccggcggcagtcaggacgtgcgccggttcatggaccgagaggccactccgccccggggccacggttcagcgcgctatccgccggagcaggagaggagcccctcgccgccacctcctctgcccaccaagcgccgaaagtatcagcgggtgggctccgggtcttccgaggaggacgtggtccccgtggacagccctccaaaaaagaagcaagccagaaagaccaagcatgtgaccaagacggaccccgacgaagagatgccccaggaagaagccgtgatcgtgggagtgggattcagccagccgccggtcctgttgaaggaaggaaaggacggaaaacgcatcgtagagcccgcgacccccggtgtcctgaacgtgcgcaaccccctgagtctgcctctggtctcgtcctgggagaagggcatggataccatgaacgtgctgatggaacgctatcgcgtcgacagcggcctgcgcgatgcttacaagctcatgcccgagcagaccgagatcttccaaaagatgtgccagacctggatgaacgaggaggcccgcggcctgcaactgaccttcagcaccagtaaatcatttagcaccgtgatgggccgcatgttgcaaggttacatattcagccacagcgggatcgcgcacaagaattgggaatgcaccggctgcgccctgtgggatcacggctgcaccgaggtggaaggccagctcaagtgcctgcatggaacggtgatgatccacaaggatcacgtggtggagatggatgtgaccagcgagaacggccagcgtgcgttgaaggagcagcccagcaaggccaaggtgacccagaaccgctggggacggagcgtggtgcaactgaccagccatgacgcgcgctgctgcgtgcatgatgccgggtgtggaaataaccagttcagcgggaagagctgcggcctgttcttcagcgagggggccaaggcccagcaagctttcaagcagatcttggcctttgtcaaggccctctacccgaatatgcagcgcggctcggggatgatgctgatgccagtgcactgcgagtgtaaccacaagcctcagagcgtgcccttcctgggccgccagctgtgcaagatgacaccgttcggcctgagcaacgccgaggacctggacaaggatcagatcagcgacaagagcgtgctggccagcgtgaagcaccccagtctgatggtgttccagtgctgcaaccccgtgtaccgcaactcgcgcgcgcagagcaccggtcccaactgcgatttcaagatctccgcgcctgacatactgggcgccctgcagatgagccggcgcatgtggagcgagaccttccccgagaccccagtgcccaaactggtgatccccgagttcaagtggcagcccaagtaccagtaccgcaacgtggccctccccagcgcggcgcacaacgacgagcgcgagaaccccttcgacttttaa

SEQ ID NO: 1250 - DNA, 630 bp, Adenovirus D33
  MISC_FEATURE (1)..(630): D33.orf00034 L3 23.6 kDa protease
atgagcggctccagcgaaagagagctcgcggccatcgtgcgcgacctgggctgcgggccctactttttgggcacccacgacaagcgcttccctggcttcctcgccggcgacaagctggcctgcgccatcgtcaacacggccggccgcgagaccggaggcgtgcattggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctgaggcgcaaccaggaggagctctaccgcttcctagcgcgccactccccttactttcgatcccaccgcgccgccatcgaacacgccaccgcttttgataaaatgaaacaactgcgtgtatctcaataa

SEQ ID NO: 1251 - DNA, 2862 bp, Adenovirus D33; identical to SEQ ID NO: 216
  MISC_FEATURE (1)..(2862): D33.orf00036 L3 hexon

SEQ ID NO: 1252 - DNA, 705 bp, Adenovirus D33
  MISC_FEATURE (1)..(705): D33.orf00037 L3 pVI
atggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgtctggacccgcggccgcccacggtggtggagatggaagatgcaactcttccgccgcccaagggcgagaagcgcccgcggcccgacgcggaggagacgatcctgcaggtggacgagccgccctcgtacgaggaggccgtgaaggccggcatgcccaccacgcgcatcatcgcgccgctggccacgggtgtaatgaaacccgccacccttgacctgcctccaccacccacgcccgctccaccgaaggcagctccggttgtgcagccccctccggtggcgaccgccgtgcgccgcgtccccgcccgccgccaggcccagaactggcagagcacgctgcacagtatcgtgggcctgggagtgaaaagtctgaagcgccgccgatgctattga

SEQ ID NO: 1253 - DNA, 225 bp, Adenovirus D33
  MISC_FEATURE (1)..(225): D33.orf00038 L2 pX core protein L2 pX
atggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatccctggcatagcttccgttgcgctgcaggcgtcgcagcgccgttga

SEQ ID NO: 1254 - DNA, 1032 bp, Adenovirus D33
  MISC_FEATURE (1)..(1032): D33.orf00040 L2 pV
atgcttgtgtcctcccccccgcaagcgacgatgtcaaagcgcaaaatcaaggaggagatgctccaggtcgtcgccccggagatttatggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctcatctcgctgccgctggacgagagcaaccccacgccgagcctgaagcccgtgaccctgcagcaggtgctgccccaggcggtgctgctgccgagccgcggggtcaagcgcgagggcgagaacatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgtctccacttctaccgccgccacggctaccgagcctcccaggaggcgaagatggggcgccgccagccggctgatgcccaactacgtgttgcatccttccattatcccgacgcctggctaccgcggcacccggtactacgccagccgcaggcgcccagccaccaagcgccgccgccgcaccacccgccgccgtctggccccagcccgcgtgcgccgcgtaaccacgcgccggggccgctcgctcgttctgcccaccgtgcgctaccaccccagcatcctttaa

SEQ ID NO: 1255 - DNA, 585 bp, Adenovirus D33
  MISC_FEATURE (1)..(585): D33.orf00041 L2 pVII
atgtctattctcatctcacccagcaataacaccggctggggtcttactaggcccagcaccatgtacggaggagccaagaagcgctcccagcagcaccccgtccgcgtccgcggccacttccgcgctccctggggagcttacaagcgggggcggacttccaccgccgccgtgcgcaccactgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccacaggagcacgcccgccatgcgcgccgcccgagctctgctgcgccgcgccagacgcacgggtcgccgggccatgatgcgagccgcgcgccgcgccgccactgcaccccccgcaggcaggactcgcagacgagcggccgccgccgccgccgcggccatttctaacatgaccagacccaggcgcggaaacgtgtactgggtacgcgactccgtcacgggcgtgcgcgtgcccgtgcgcacccgtcctcctcgtccctga

SEQ ID NO: 1256 - DNA, 1554 bp, Adenovirus D33; identical to SEQ ID NO: 186
  MISC_FEATURE (1)..(1554): D33.orf00042 L2 penton

SEQ ID NO: 1257 - DNA, 1692 bp, Adenovirus D33
  MISC_FEATURE (1)..(1692): D33.orf00045 L1 pIIIa
atgcagcaagccccggaccccgccataagggcggcgctgcaaagccagccgtccggtctagcatcggacgactgggaggccgcgatgcaacgcatcatggccctgacgacccgcaaccccgagtcctttagacaacagccacaggccaacagactttcggccattctggaggcggtggtcccctctcggaccaaccccacgcatgagaaggtgctggcgatcgtgaacgcgctggcggagaacaaggccatccgtcccgacgaggccgggctggtgtacaacgccctgctggagcgcgtgggccgctacaacagcacaaacgtgcagtccaacctggatcggctggtgacggacgtgcgcgaggccgtggcgcagcgcgagcgattcaagaacgagggccttggctcgctggtggcgctgaacgccttcctggcaacgcagccggcgaacgtgccgcgcgggcaggacgattataccaactttatcagcgcgctgcggctgatggtgaccgaggttccccagagcgaggtgtaccagtcgggcccggactactttttccagactagcagacagggcctgcagacggtgaacctgagccaggctttcaagaacctgcgcgggctgtggggcgtgcaggcgcccgtgggcgaccggtcgacggtgagcagcttgctgacgcccaactcgcggctgctgctgctgctgattgcgcccttcaccgacagcggcagcgtgaaccgcaactcgtacctgggccacctgctgacgctgtaccgcgaggccataggccaggcgcaggtggacgagcagaccttccaggagattactagcgtgagccgcgccctgggtcagaacgacaccgacagtctgagggccaccctgaacttcttgctgaccaatagacagcagaagatcccggcgcagtacgcgctgtcggccgaggaggagcgcatcctgagatatgtgcagcagagcgtagggctgttcctgatgcaggagggcgccacccccagcgctgcgctggacatgaccgcgcgcaacatggaacctagcatgtatgccgccaaccggccgttcatcaataagctgatggactacctgcaccgcgcggcggccatgaactcggactactttaccaatgccattttgaacccgcactggctcccgccgccggggttctacacgggcgagtacgacatgcccgaccccaacgatgggttcctgtgggacgacgtggacagcgcggtgttctcaccgaccttgcaaaagcgccaggaggcggtgcggacgcccgcgagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggagcctgcgcccgcgccgcggcgccagcgccacgaccggcagcggggcctggtgtgggacgacgaggactcggccgacgatagcagcgtgttggacttgggcgggagcggtggggccaacccgttcgcgcatctgcagcccaaactggggaggcggatgttttga

SEQ ID NO: 1258 - DNA, 1122 bp, Adenovirus D33
  MISC_FEATURE (1)..(1122): D33.orf00048 L1 52 kDa protein
atgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgcgtgcagctacagaaggacgtgcgcccggcgtacgtgcctccgcagaacctgttcagggaccgcagcggggaggagcccgaggagatgcgcgactgccgttttcgggcgggcagggagctgcgcgagggcctggaccgccagcgcgtgctgcgcgacgaggatttcgagccgaacgagcagacggggatcagccccgcgcgcgcgcacgtggctgcggccaacctggtgacggcctacgagcagacggtgaagcaggagcgcaacttccaaaagagtttcaacaaccatgtgcgcacgctgatcgcgcgcgaggaggtggccctgggcctgatgcacctgtgggacctggcggaggccatcgtgcagaatccggacagcaagcctctgacggcgcagctgttcctggtggtgcagcacagcagggacaacgaggcgttcagggaggcgctgctgaacatcgccgagcccgagggccgctggctgctggagctgattaacatcttgcaaagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcgcgagccggcggcgcgagctgagcgaccgcgagctgatgctgagcctgcgccgggcgctggtagggggcgccgccggcggcgaggagtcctacttcgacatgggggcggacctgcattggcagccgagccggcgcgccttggaggccgcctacggtccagaggacgacttggatgaggaagaggaggaggatgcacccgctgcggggtactga

SEQ ID NO: 1259 - DNA, 1854 bp, Adenovirus D33
  MISC_FEATURE (1)..(1854): D33.orf00049 pTP
atggattatttcctgccgctgcgcaacatctggaaccgcgtccgcgagttcccgcgcgcctccaccaccgccgccggcatcacctggatgtcccgctacctctacggctaccaccgcctcatgctcgaggacctggcccctggcgcgccggccacccagcgctggccgctctaccgccagccgccgccgcacttcctagtcggataccagtacctcgtgcgcacctgcaacgactacgtcttcgactcgcgcgccttctcgcggctcaggtactccgagatcgtgcaacccggcctgcagaccgtcaactggtcgctcatggccaactgcacctacaccatcaacaccggggcctaccaccgcttcgtcgacatggacgacttccaggacaccctcacccgcgtgcaacaggccatcctcgccgagcgcgtcgtcgccgacctggcgcttgtgcaaccgctcaggggcgtcggggtcacccgcatggaagactccgcctccgccagtgatgacattgagaggctcatgcatgactactacaagaacctgagccggtgtcagggccaggcctggggcatggccgagcggctccgcatccagcaagcgggacccaaggacctggtcctcctcgccaccatccgccgccttaaaaacgcctacttcaattacatcatcagcaaccgcaattctaacagcgtccacggggctactacgtgtttgagcttaccttgcgactgcgattggctagacgctttcctcgaaagattctccgatccggtcgatctcgacgcgctcacgtcccctacaccgcaattgataagatgcatcgtcagcgccctatcgctgcccaacggggacccgccccattaccgggagatgaccggcggcgtcttcacgctgcgtcctcgcgaacggggtcgcgccgtcaccgaaaccatgcgtcgccgccgcggggagatgatcgagcgcttcgtcgaccgtctcccggtgcgtcgccgtcgtcgtcgggccccgccaccaccaccgcccccagaggaagaaatagaagaagaggtcgtcatggaagaagaggaagaggaggaggcccccggggatttcgagcgcgaggtgcgcgccaccatcgccgagctcatccggctcctggaagacgagctcacggtctcggcccgcaacgcccagtttttcaacttcgccgtggatttctacgaagccatggaaaggctggaggccatcggcgacatcagcgagatgcccctgcgccgctggatcatgtacttcttcgtcaccgagcacatcgccaccaccctcaactacctcttccagcgcctgcgcaactacgccgtcttcacgcggcacgtggagctcaacctcgcgcaggtggtcatgcgcgcgcgcgacgccgacggggacgtagtctacagccgcgtctggaacgagagcgggctgggcgccttctcgcagctcatgggtcgcatctcaaatgacctcgccgccaccgtcgagcgcgcgggccgcggcgatctccaggaggaggagatcgagcagttcatgtccgagatcgcctaccaggacaactcgggcgacgtgcaagagatcctgcgtcaggccgccgtcaatgacgccgagattgattctgttgaactgtctttcaggttcaaagtcacggggcccgtggtcttcacgcagaggcggcagatccaggatgtcaaccgccgcgtcgtcgcgcacgccagcgctctcagggcgcagcaccgggacctgcccgagcgccacgccgacgtgcctctgccgcccctgcccgcggggccggaaccgccgctgccgccgggagcgcgtccgcgacaccgcttctaa

SEQ ID NO: 1260 - DNA, 3300 bp, Adenovirus D33
  MISC_FEATURE (1)..(3300): D33.orf00051 E2B DNA polymerase
gtggccccgcgcagctacgggctcatgcaatgcgtggacacggccaccaactccccagtggaaatcaagtaccatctgcatctcaagcacgccctcacccgcctctacgaggtcaacctcagaaccctgcccccggacctggatctccgcgacaccatggacagctcccaactgcgtgccctcgtcttcgctctccgcccccgccgcgccgagatctggacctggctcccgcgcgggctcgtcagcctctccgtcctcgaggagccccagggtgagtcccacgcaggcgaacatgaaaaccaccagccagggccgccactcctgaagttcctcctcaagggacgcgcagtgtatctcgtggatgaggtacagcccgtgcagcgctgcgagtactgcggacgcttttacaagcatcagcacgagtgctcggttcgccggcgggatttctactttcatcacatcaacagccactcgtccaactggtggcaggaaatccagttcttcccaatcggctctcatcctcgcacggagcggctctttgtcacctacgatgtagaaacctacacctggatggggtccttcggcaagcagctcgtccccttcatgctggtcatgaaattctcgggggaccccgagctggtcgccctcgctcgcgatctcgccgtgcgcttacgctgggatcgctgggagcgggaccccctcaccttctactgcgtcaccccagaaaagatggccgtgggccagcagttccgcctctttcgcgacgagctccagaccctcatggcccgcgagctctgggcttccttcatgcaagccaacccacatctccaggagtgggccctcgagcagcacggcctgcaatgccccgaggacctcacctacgaggagctcaaaaagctgccgcacatcaaaggccgcccgcgattcatggaactttacatcgtcgggcacaacatcaacggcttcgacgagatcgtcctcgccgcccaggtcatcaacaaccgagcctccgtcccgggccctttccgcatcagccgcaatttcatgccgcgagcaggcaagattctcttcaatgacgtcactttcgctctgcctaaccccctctcgaagaagcgcaccgatttcgagctctgggagcacggcggctgcgacgactcggacttcaagtaccagttcttgaaagtcatggtcagggacaccttcgccctgactcacacctcgctccgcaaggccgctcaagcttacgccctccccgtggagaagggctgctgtccctacaaggccgtgaaccatttctacatgctgggctcttaccgtgcggacgatcgaggattcccgctccgggagtactggaaggatgacgaggagtatgccctcaaccgcgagctgtgggagaagaaaggagaggcgggttatgacatcatccgagaaacgctggactactgcgccatggacgtcctcgtcaccgccgagctcgtcgccaagctgcaagactcctacgcgcacttcatccgcgactcggtccgactgccccacgcccactttaacatcttccaacggcccaccatctcctccaactcgcacgccatctttcgccagatcgtcttccgcgccgagcagccccagcgcaccaatctcggccccgccttcttggccccctcgcacgagttgtatgactacgtgcgcgccagcatccgcggggggcgctgttatcccacctacatcggcatcctctcagagcccatctatgtgtatgacatctgcggcatgtatgcctccgcgctcacgcaccccatgccctggggtccgcccctcaacccctacgagcgagcgatggccgcccgcgagtggcagatggccttggatgatgcatcctcaaaaatagactattttgacaaggaactatgtcccggcatcttcaccatcgatgcggacccccctgacgagcatctgcttgatgtgttgccccctttctgctcgcgcaagggcggcagactctgctggaccaacgagcccctgcgcggcgaggtggccaccagcgtggacctggtcaccctgcataaccgcggctggcgcgtcaggatcgtgcccgacgagcgcaccgccgtcttccccgaatggaagtgcgtcgcgcgcgagtatgtccagctcaacatcgcggccaaggagcgcgccgaccgtgacaaaaatcagaccatgagatccatcgccaagcttctctccaatgccctctatggctccttcgccaccaagcttgacaataaaaaaatagtcttttctgaccagatggatgaaagtctcctaaaaagcatcgcggcagggcaagccaacatcaaatcctcctcgtttctagaaactgacaacctgagtgccgaggtcatgcccgctctcgagagggaatacctaccccaacagctggcgctcgtggacagcgacgcggaagagagtgaggacgagcacagacccgcccccttttatacccccccgtcggggaccccaggtcacgtggcctacacctacaagccaataaccttcttggatgcggaggagggggacatgtgcctgcataccgtggaaaaagtggaccccctggtggacaacgaccgctacccctcgcacgtggcctcctttgtcttggcgtggacgcgcgcctttgtctcagagtggtccgagtttctctacgaggaggaccgcgggacgcccctgcaggacaggcccatcaagtccgtctacggggacacagacagcctgtttgtcaccgagcgcggacacagactcatggagacgcgaggtaagaagcgcatcaaaaagaacgggggaaaactggtttttgaccccgaacaccccgagctcacctggctcgtcgagtgcgagaccgtctgcgcccactgcggagcggacgccttcgcccccgagtccgtctttctcgcacccaagctctacgccctgcaatccctcctctgtcccgcctgcgggcgctcttccaagggcaagctccgcgccaagggccacgccgccgaggccctcaactacgagctcatggtcaactgctatctcgccgacgcgcagggcgaagaccgtgcccgtttcagcaccagcaggatgagtctcaagcgaacccttgcaagcgcccagcccggggcccaccccttcaccgtgacggagaccacgctcacgcggaccctgagaccatggaaggacatgacgctggcagcgctggacgcccatcgtctcgtgccctacagtcgcagtcgtcccaacccccgaaacgaggaagtctgctggatcgagatgccgtag

SEQ ID NO: 1261 - DNA, 1047 bp, Adenovirus D33
  MISC_FEATURE (1)..(1047): D33.orf00052 pIVa2
atgcccatggccgacgggctcaagcccctgaaaaactttgcttccctgcaagagctactctcgctcggcggagaccgcctccttggcgagctcgtccgggaaaacctccaagtcagggacatgctcaacgaggtggcccccctcctccgggacgacggcagctgcatctccttgaactaccacctgcaacccgtcatcggggtcatctacggcccaaccgggtgcggcaagtcccagctgttgagaaacctgctctcctcgcagctcatcacccccgccccggaaaccgtttttttcatcgccccgcaggtggacatgatccccccctccgagatgaaagcctgggagatgcagatctgcgaggggaactttgccccggggcccgagggaaccatcgtcccccaatctggcaccctccgccccaaatttattaaaatgtcttatgatgatctcacccaggagcataattacgatgtctctgaccccagaaacgtctttgccaaagccgcagcccacgggcccattgccatcatcatggatgagtgcatggaaaacctgggcgggcacaagggcgtctccaaattcttccacgcattcccttccaagttgcatgataagttccccaagtgcacgggctacaccgtcctggtggtcctgcacaacatgaaccccaggcgggatctgggcggcaacattgccaacctcaagatccaggccaaactgcacatcatctccccccgcatgcatccctcccagctcaaccgctttgccaacacctacaccaaggggctccccgtggccatcagtctcctcctcaaggacatcatccagcaccacgcccagcgcccctgctatgactggatcatctacaacacgaccccagagtacgaggccatgcagtggtgctacctacacccccgggacgggctcatgcccatgtacctcaacatccaatcccacctctaccgggtcctggaaaaaatccaccgcactctcaatgatcgggaaaggtggaccagggcctaccgcgcgcgaaaaaataaataa

SEQ ID NO: 1262 - DNA, 402 bp, Adenovirus D33
  MISC_FEATURE (1)..(402): D33.orf00054 IX pIX
atgaacgggactggcggggccttcgaaggggggctttttagcccttatttgacaacccgcctgccgggatgggccggagttcgtcagaatgtgatgggatcgacggtggacgggcgcccagtgcttccagcaaattcctcgaccatgacctacgcgaccgtggggaactcgtcgcttgacagcaccgccgcagccgcggcagccgcagccgccatgacagcgacgagactggcttcgagctacatgcccagcagcagcagtagcccctctgtgcccagttccatcatcgccgaggagaaactgctggccctgctggccgagctggaagccctgagccgccagctggccgccctgacccagcaggtgtccgatctccgcgagcaacagcagcaaaataaatga

SEQ ID NO: 1263 - DNA, 1488 bp, Adenovirus D33
  MISC_FEATURE (1)..(1488): D33.orf00056 E1B 55 kDa protein
atggagccagaacacccaactgagcaggggctacattctggacttcgcggccatgcacctgtggagggcctgggtcaggcagcggggacagagaatcttgaactactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcagggtgctgacatccatggccaggggagtgaagagggagaggagcgatgggggcaataccgggatgatgacagagctgacggccagcctgatgaatcgcaagcgcccagagcgcattacctggcatgagctacagatggagtgcagggatgaggtgggcctgatgcaggataaatatggcctggagcagataaaaacccactggttgaacccagatgaggattgggaggaggccattaagaaatatgccaagatagccctacgcccagattgcaagtacagggtgaccaagacggtgcatatcagacatgcctgctacatctcagggaacggggcagaggtggtcatcgataccctggacaaggccgccttcaggtgttgcatgatgggaatgagagccggagtgatgaatatgaattccatgatctttatgaacatgaagttcaatggagagaagtttaatggggtgctgttcatggccaacagccacatgaccctgcatggctgcgactttttcggctttaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacatgcgactcgggggtctgccatattctgaagaacatccatgtgacctcccacccccggaagaagtggccagtgtttgagaataacctgcttatcaagtgccacgtgcacctgggtgccagaaggggcaccttccagccgtaccagtgtaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattag

SEQ ID NO: 1264 - DNA, 207 bp, Adenovirus D33
  MISC_FEATURE (1)..(207): D33.orf00058 E1A 14.9 kDa protein
gtgtcagaggatgagtcatcgccctcagaagacgaccacccgtctccccccgatctcacagatgacacgcccctgcaagtgatcagacccaccccagtcagactcagtggggagaggcgaatggctgttgacaaaatcgaggacttgttgcaggacatgggtggggatgaacctttggacctgagcttgaaacgccccaggaactag

SEQ ID NO: 1265 - DNA, 579 bp, Adenovirus D33
  MISC_FEATURE (1)..(579): D33.orf00059 E1A 28 kDa protein
atgagacacctgcgcctcctgcctgaaactgtgcctatggacatggctgtgcttctactggatgactttgtgaatacagtattggaggatgaactgcatccaactccgtttgagctgggacccacacttcaggacctatatgatctggaggtagatgcccatgatgacgacccgaacgaagaggctgtgaatttaatatttccagaatctatgattcttcaggctgacatagccaacgaatctatacctactccacttcatacaccgactctgtcacccatacctgaattggaagaggaggacgaactagacctccggtgttatgaggaaggttttcctcccagcgattcagaggacgaacagggtgagcagagcatggctataatctcagactatgcttgtgtggttgtggaagagcattttgtgttggacaatcctgaggtgcccgggcaaggctgtagatcctgccaatatcaccgggatcagaccggagacccaaatgcttcatgcgctctgtgttacatgaaaaagactttcagctttatttacagtaagtggagtgaatgtgagagaggctga

SEQ ID NO: 1266 - DNA, 138 bp, Adenovirus D37
  MISC_FEATURE (1)..(378): D37.orf00002 E4 14.0 kDa protein
atggctgaatctctgtatgcttttatagatagtcctggagggattgctcccgtccaggaaggggctagcaatagatataatttttttgccctgaatctttccacattcctccgcatggggtggtattgcttcacctaa

SEQ ID NO: 1267 - DNA, 258 bp, Adenovirus D37
  MISC_FEATURE (1)..(258): D37.orf00003 E4 14.0 K E4 ORF1 14.0 kDa protein
gtggtattgcttcacctaaaagtgagtgtgctggttcctactggatatcagggcagatttatggccttgaatgactaccatgccagggacatactaacccagtctgatgtgatttttgccggaagaagacaggaacttactgtgctgctttttaatcacacggaccgatttttgtatgtccgcaagggccacccagtgggtaccctgctgctggagagagtgatttttccttcagtgaaaatagccaccttagtttag

SEQ ID NO: 1268 - DNA, 393 bp, Adenovirus D37; identical to SEQ ID NO: 897
  MISC_FEATURE (1)..(393): D37.orf00004 E4 14.5 K E4 ORF2 14.5 kDa protein

SEQ ID NO: 1269 - DNA, 354 bp, Adenovirus D37
  MISC_FEATURE (1)..(354): D37.orf00006 E4 13.6 K E4 ORF 3 13.6 kDa protein
atgaaggtctgcctgattatgaaagtggagggggcactgtgggagcttttccacatgtgcggagtggacttacaccaacaatttgtagagataatccaaggctggaaaaatgagaattacctggggatggtgcaggaatgtaacctgatgattgatgaaatcgatggagggccagcctttaatgtgattcttatgctggatgtgcgcgtagagccactgctcgaagccacggtcgagcaccttgaaaatagagtgggttttgacctggctgtctgtttccaccagcacagcggaggggaacgctgtcacctgcgtgacttgcactttatcgtccttcgagaccgtttggaataa

SEQ ID NO: 1270 - DNA, 159 bp, Adenovirus D37
  MISC_FEATURE (1)..(159): D37.orf00008 E4 14.2 K E4 ORF4 14.2 kDa protein
atgctgttcaagggcccatttctgctggcagaagtacgacaaggtacgcaagagaatccactacaatgcaaaccgagattcaatccagctcgctccgccatcatccatatcgcagggcccgtttaccacgatctgatgaggaaaccagggcttcactga

SEQ ID NO: 1271 - DNA, 663 bp, Adenovirus D37
  MISC_FEATURE (1)..(663): D37.orf00009 E4 34.1 kDa protein
atgatcctcaccacagaggaaataaaaattttaaaaagatgtatgtcagtgtgcctgtgccccgctaccctggacttggtaagagctcaaatggtgagcgggtacgagcgctggatcctgcattgccactgttcatcccctggctccctgcagtgtcgggcgggaggcaccctgctggccgtgtggttcaggagagtcatttacgggtgcatgttcaaccagcgcttcccctggtaccgccagattgtaaacagaaacatgcccaaagagatcatgtacatgggcagtgtgttcatgaggggcaggcacctgatatactgtcgcatctggtacgatggtcacgtgggttccatcattcccaacatgagctttggctggagcgccctgaattatgggctgctgaataacatggtgattatgtgctgcacttactgtgagaacatggcagagatcaggatgcggtgctgtgcccgtcgcaccaggagactgatgctgaaggctgttgggatcatagtcagagagacttgtgatcccgatcccatttgcagcagccgcaccgagccccggcggcagagactgctgagggcgctgatggagaggcacagacccatcctgttttccgagtatgaatctgtgcgttcttctcgttccaccagactgtga

SEQ ID NO: 1272 - DNA, 246 bp, Adenovirus D37
  MISC_FEATURE (1)..(246): D37.orf00010 E4 ORF6/7 protein
gtgaccttggactgtgaggcccgcttggatgacttttcagaggacggctttatttcaatcaccgacccccgtttggctcgccaggaaactgtgtggattatagaccccaagtccaattcccgcactaatgagaatatttccctatttaaggctacccgtgctgagagaaccgtgtacactgtaaaatgggctggtggtgggagactgtctactcgtgctggtgtaaaaatcaataaagatacatga

SEQ ID NO: 1273 - DNA, 1098 bp, Adenovirus D37; identical to SEQ ID NO: 157
  MISC_FEATURE (1)..(1098): D37.orf00013 L5 fiber

SEQ ID NO: 1274 - DNA, 150 bp, Adenovirus D37
  MISC_FEATURE (1)..(150): D37.orf00014 U protein
atgaaaattgtggaccaggaatttgacatccctttcaaggtgtggaggaagttcgccgcccgccggggactggagtaccagagctgggaggagggtaccgaggtgttgctgagcaactacaccagagacatactttcagatttcaagtaa

SEQ ID NO: 1275 - DNA, 393 bp, Adenovirus D37
  MISC_FEATURE (1)..(393): D37.orf00016 E3 14.8kDa protein
atgactgaccaccacctggacctcgagatggacggccaggcctccgagcagcgcatcctgcaactgcgcgtccgtcagcagcaggagcgggccgccaaggagctccttgatgccatcaacatccaccagtgcaagaagggcatcttctgcctggtcaaacaggcaaagatcacctacgagctcgtgtccaacggcaaacagcatcgccttacctatgagatgccccagcagaagcagaagttcacctgcatggtgggcgtcaaccccatagtcatcacccagcagtcgggcgagaccaacggctgcatccactgctcctgcgaaagccccgagtgcatctactcccttctcaagaccctttgcggactccgcgacctcctccccatgaactga

SEQ ID NO: 1276 - DNA, 393 bp, Adenovirus D37
  MISC_FEATURE (1)..(393): D37.orf00018 E3 14.7kDa protein
atgcagactctgctcatgctgctatccctcctatcccctgccctagccacttatgctgattactctaaatgcaaattcgcagacatatggaatttcttagattgctatcaggaaaaaattgatatgccctcctattacttggtgattgtgggaatagtcatggtctgctcctgcactttctttgccatcatgatttacccctgttttgatctcggctggaactctgttgaagcattcacatacacactagaaagcagttcactagcctccacgccaccacccacaccgcctcctcgcagaaatcagttccccctgatacagtacttagaagagccccctccccgacccccttccactgttagctactttcacataaccggcggcgatgactga

SEQ ID NO: 1277 - DNA, 276 bp, Adenovirus D37
  MISC_FEATURE (1)..(276): D37.orf00019 E3 10.4kDa protein
atgattcctaggttcttcctatttaacatcctcttctgtctcttcaacatctgcgctgcctttgcagccgtctcgcacgcctcgcccgactgtctcgggcccttcccaacctacctcctctttgccctgctcacctgcacctgcgtctgcagcattgtctgcctggtcatcaccttcctgcagcttatcgactggtgctgtgcgcgctacaattatctccatcacagtcccgaatacagggacaagaacgtagccagaatcttaaggctcatctga

SEQ ID NO: 1278 - DNA, 843 bp, Adenovirus D37
  MISC_FEATURE (1)..(843): D37.orf00023 E3 30.7kDa protein
atgaaggctttcacagcttgcgttctgattagcctagtcacacttagtgtagctattaaaaatcaatatcatgttcataatgttaccagagatggatatatcacattaaatgtaacaattgataatactacctggacaagatatcatttaaataagtggcatcaaatttgtacgtggtcagacccatcatacaaatgtcacagcaatggcagcattaccattcatgctttcaatattacttctggccagtacaaagctgaaagttttactaactggtttagatattacggtaatcataaacatgaaattcatatttttaacataactgtaattgagcatcctacaacaaaagcacccaccactgctaatacagctacatcaattaaatcaacaaccacacagcctactactagggagacaactcaacctaccaccacagtcagtacaactactgagaccactactcaaactacacagctagacacaacagtgcagaatagcactgtgttggttaggtatctgttgagggaggaaagtactactgaacagacagaggctacctcaagtgcctttagcagcactgcaaatttaacttcgcttgcttggactaatgaaaccggagtatcattgatgaatcatcagcctttctcaggtttggatattcaaattacttttctggttgtttgtgggatctttattcttgtggttcttctgtactttgtctgctgcaaagccagagagaaatctaggaggcccatctacaggccagtaatcggggaacctcagccactccaagtggaagggggtctaaggaatcttcttttctctttttcagtatggtga

SEQ ID NO: 1279 - DNA, 1287 bp, Adenovirus D37
  MISC_FEATURE (1)..(1287): D37.orf00024 E3 47.5kDa protein
atgaatacagtgatccgtatcgtgctgctctctcttcttgtagcttttagtcaggcaggatttcatactatcaatgctacatggtgggctaatataactttagtgggacccccagacacaccagtcacttggtatgatactcaaggattgtggttttgcaatggcagtagagttaagaatcctcaaatcagacatacatgtaatgatcaaaaccttactttgatccatgtgaacaaaacttatgaaagaacatacatgggttataatagacaagggactaaaaaagaagactacaaagttgtagttataccacctcctcctgctactgtaaaaccacagccagagccagagtatgtgtttgtttatatgggagagaacaaaactctagaaggtcctccgggaactccagtcacatggtttaatcaggatggaaagaaattttgtgaaggagaaaaagttcttcatccagaatttaaccacacctgtgacaaacaaaaccttatactactgtttgtgaattttacacatgatggagcttaccttgggtacaatcatcaaggaacccagagaacacactatgaagttacagtattagatctttttccagattctggccaaatgaaaattgaaaatcatagtgaggaaacagagcaaaaaaatgatgaacatcataactggcagaaacagggtgggcaaaaacagggtgggcaaaaaacaaatcaaacaaaagttaatgacaggagaaaaacagcgcaaaaaagaccatcaaagctaaagccggcaactattgaggcaatgctggttacagtgactgccgggtctaacttaactttggttggacctaaagcagaaggaaaagttacttggtttgatggagatttaaaaagaccatgtgagcctaattacagactaagacacgaatgtaataatcaaaacttaactctgattaatgtaactaaagattatgagggaacttactatggtacaaatgacaaagatgagggcaaaaggtacagagtgaaagtaaatactacaaattctcaatctgtgaaaattcagccatataccagacaaactactcctgatcaagagcacaaatttgaattacagttcgaaactaatggaaattatgattcaaaaattccctcaaccactgtggcaatcgtggtgggtgtgattgcgggcttcataactctgatcattgtcttcatatgctacatctgctgccgcaagcgtcccagggcatacaatcatatggtagacccactactcagcttctcttactaa

SEQ ID NO: 1280 - DNA, 471 bp, Adenovirus D37
  MISC_FEATURE (1)..(471): D37.orf00028 E3 18.6kDa protein
atgaaggggctcttgctgattatcctttccctggtggggggtgtgctgtcatgccacgaacagccacgatgtaacatcaccacaggcaatgagaggaacgactgctctgtagttatcaaatgcgagcaccattgtcctctcaacattacattcaaaaataagaccatgggaaatgtatgggtgggattctggcaaccaggagatgagcagaactacacggtcactgtccatggtagcaatggcaatcacactttcggtttcaaattcatttttgaagtcatgtgtgatatcacactacatgtggctagacttcatggcttgtggccccctaccaaggataacatggtgggtttttctttggcttttgtgatcatggcctgcttgatgtcaggtctgctggtaggggctctagtgtggtttctgaaacgcaagcccaggtatggaaatgaagagaaggaaaaattgctataa

SEQ ID NO: 1281 - DNA, 567 bp, Adenovirus D37
  MISC_FEATURE (1)..(567): D37.orf00029 E3 21.8kDa protein
gtggtgagtttaataaaagctaaactcttgcaatactctggaccttgtcgtcatcaactcaacgagaccgtctacctcaccaaccagactgaggtaaaacttacctgcagaccacacaagacctatatcatctggttcttcgagaacacctcatttgcagtctccaacactcactgcaacgacggtgttgaacttcccaacaacctttccagtggactgagttacaatacacgtagagctaagctcatcctctacaatccttttgtagagggaacctaccagtgccagagcggaccttgcttccacagttttactttggtgaacgttaccggcagcagcacagccgctccagaaactaaccttccttctgatactatcaaaccttgtttcggaggtgagctaaggcttcccccttctcaggagggggttagcccatacgaagtggtcgggtatttgattttaggggtggtcctgggtgggtgcatagcggtgctagctcagctgccttgctgggtggaaatcaaaatctttatatgctgggtaagacattgtggggaggaactatga

SEQ ID NO: 1282 - DNA, 321 bp, Adenovirus D37
  MISC_FEATURE (1)..(321): D37.orf00030 E3 12.2kDa protein
atgtcctatggtgactcggctgagctcgctcggttgaggcatctggaccactgccgccgcctgcgctgctttgcccgggagagctacggcctcatctactttgagctgcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatttgtcctaccccgaagttgcatgagaatttttgttgtactctttgtggtgagtttaataaaagctaa

SEQ ID NO: 1283 - DNA, 684 bp, Adenovirus D37
  MISC_FEATURE (1)..(684): D37.orf00032 L4 pVIII
atgagcaaggagattcccaccccttacatgtggagctatcagccccagatgggcctggccgcgggcgcctcccaggactactccacccgcatgaactggcttagtgccggcccctcgatgatctcacgggtcaacggggtccgtaaccatcgaaaccagatattgttgcagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcaatcggtctgcgaccggacggagtgttccaactagccggagccgggagatcgtccttcactcccaaccaggcctacctgaccttgcagagcagctcttcggagcctcgctcgggaggcatcggaaccctccagttcgtggaggagtttgtgccctcggtctacttcaaccccttctcgggctcgccaggcctctacccggacgagtttataccgaacttcgacgcagtgagagaagcggtggacggctacgactga

SEQ ID NO: 1284 - DNA, 219 bp, Adenovirus D37
  MISC_FEATURE (1)..(219): D37.orf00033 L4 20 kDa protein
ttgaccaccagggagctgaggaaccggatcttccccactctttatgccatttttcagcaaagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctgactcttaaagactaa

SEQ ID NO: 1285 - DNA, 186 bp, Adenovirus D37
  MISC_FEATURE (1)..(186): D37.orf00034 L4 22 kDa protein
gtgaagggtgacggtaagcacgagcgacagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaa

SEQ ID NO: 1286 - DNA, 2199 bp, Adenovirus D37
  MISC_FEATURE (1)..(2199): D37.orf00035 L4 100kDa protein
atggaggagcagccgcgtaagcaggagcaggaggaggacttaaccacccacgagcaacccaaaatcgagcaggacctgggcttcgaagagccggctcgtctaaaacccccacaggatgaacaggagcacgagcaagacgcaggccaggaggagaccgacgctgggctcgagcatggctacctgggaggagaggaggatgtgctgctaaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggcccttgccacctatcacatctttttcaagaaccaaaagatccccatctcctgtcgcgccaatcgcactcgcgccgacgcgctcctcgctctggggcccggcgcgcgcatacctgatatcgcttccctggaagaggtgcccaagatcttcgaagggctcggtcgggacgagacgcgcgcggcaaacgctctgaaagaaacagcagaggaagagggttacactagcgccctggtagagttggaaggcgacaacgccaggctggccgtgcttaagcgcagcgtcgagctcacccatttcgcctaccccgccgtcaacctcccgcccaaggtcatgcgtcgcatcatggatcagctcatcatgccccacatcgaggcccttgatgaaagtcaggaacagcgccccgagaacgcccagcccgtggtcagcgacgagatgctcgcgcgctggctcgggacccgcgacccccaggccctggagcagcggcgcaagctcatgctggccgtggtcctggtcacccttgagctcgaatgcatgcgccgcttttttaccgaccccgagaccctgcgcaaggtcgaggagaccctgcactacactttcagacacggtttcgtcaggcaggcctgcaagatctccaacgtggagctgaccaacctggtctcctgcctggggatcctacacgagaaccgcttgggacagaccgtgctccactctaccctgaagggcgaggcgcggcgggactacatccgcgactgcgtctttctctttctctgccacacatggcaagcggccatgggcgtgtggcagcagtgtctcgaggacgagaacctgaaggagctggacaagcttcttgctagaaaccttaaaaagctgtggacgggcttcgacgagcgcaccgtcgcctcggacctggccgagatcgtcttccccgagcgcctgaggcagacgctgaaaggagggctgcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacattgcccaccactcggatgtgatcgaggacgtgagcggcgaggggctgctcgagtgccactgtcgctgcaacctatgctccccgcaccgctccctggtctgcaacccccagctactgagcgagacccaggtcatcggtacctttgagctgcaaggtccgcaggagtccaccgctccgctgaaactcacgccggggttgtggacttccgcgtacctgcgcaaatttgtacccgaggactactacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagacttggaagaggtggaagaggagcaggcaacagagcagcccgtcgccgcaccatccgcgccggcagcccctccggtcacggatacaacctccgcagctccggccaagcctcctcgtag

SEQ ID NO: 1287 - DNA, 1473 bp, Adenovirus D37
  MISC_FEATURE (1)..(1473): D37.orf00036 E2A DNA binding protein
atggccggcggcagtcaggacgtgcgccggttcatggagcgagaggccactccgccccggggccacgggtcggcgcgctatccgccggagcaggagaggagcccctcgccgccgccacctcctctgcccaccaagcgccgaaagtatcagcgggtgggctccgggtcttccgaggaggacgtggtccccgtggacagccctccaaaaaagaagcaagccagaaagaccaagcatgtgaccaaggtagaccccgacgaagagatgccccaggaagacgccgtgatcgtgggagtgggattcagccagcctccggttctgttgaaggaaggcaaggacggaaaacgcatcgtcgagcccgcgacccctggtgtcctgaacgtgcgcaaccccctgagtctgcctctggtctcgtcatgggagaagggcatggataccatgaacgtgctgatggaacgctaccgcgtcgacagcggcttgcgcgatgcttacaagctcatgccggagcagaccgagatcttccagaagatgtgccagacctggatgaacgaggaggcccgcgggatgcaactgacattcaccacccagaaagcatttagcaccattatgggtcgcctgttgcaaggttacattttcagccacagcgggatcgcgcacaagaattgggagtgcaccggctgcgtcctgtgggatcacggctgcaccgaggtggaaggtcagctcaagtgtctgcatggaacggtgatgattcacaaggaccacgtggtggagatggatgtgaccagcgagaacggacagcgcgcgctgaaggagcagcccagcaaggctaaggtgacccagaaccgctggggacggagcgtggtgcaactgaccagccatgacgcgcgctgctgcgtgcatgatgccgggtgcgggaataaccagttcagcgggaagagctgcggcctgttttttagcgagggggccaaggcccagcaagctttcaagcagatcgcggccttcgtcaaggccctctacccgaatatgcagcgcggcgcggggatgatgctgatgcccgtgcactgcgagtgtaaccacaagcctcagagcgtgcccttcctgggccgccagctgtgcaagatgaccccgttcggcctgagcaacgccgaggacctggacaaggatcagattagcgacaagagcgtgcttgccagtgtgaagtaccccagtctgatggtgttccagtgctgcaaccccgtgtaccgcaactcgcgcgcgcagagcaccggtcccaactgcgatttcaagatctccggccctgacatgctgggcgccctgcaaatgagccggcgcatgtggagcgagaccttccccgagactccagtgcccaaactggtgatccccgagttcaagtggcagcccaagttccagtaccgcaacgtggccctccccagcgcggcgcacaacgacgagcgcgagaaccccttcgacttttaa

SEQ ID NO: 1288 - DNA, 624 bp, Adenovirus D37
  MISC_FEATURE (1)..(624): D37.orf00038 L3 protease
atgagcggctccagcgaacgagagctcgcggccatcgtgcgcgacctgggctgcgggccctactttttgggcacccacgacaagcgcttcccgggcttcctcgccggcgacaagctggcctgcgccatcgtcaacacggccggccgcgagaccgggggcgtgcactggctcgcctttggctggaacccgcgctcgcgcacctgctacatgttcgaccccttcgggttctcggaccgccggctcaagcagatttacagcttcgagtacgaggccatgctgcgccgaagcgccctggcctcctcgcccgatcgctgtcttagcctcgaacagtccacccagaccgtgcaggggcccgactccgccgcctgcggactcttctgttgcatgttcttgcatgccttcgtgcactggcccgaccgacccatggacgggaaccccaccatgaacttgctgacgggggtgcccaacggcatgctacaatcgccacaggtgctgcccaccctcaggcgcaaccaggaggagctctaccgcttcctcgcgcgccactccccctactttcgctcccaccgcgccgccatcgaacacgccaccgcttttgataaaatgaaacaactgcgtgtatga

SEQ ID NO: 1289 - DNA, 2850 bp, Adenovirus D37; identical to SEQ ID NO: 217
  MISC_FEATURE (1)..(2850): D37.orf00042 L3 hexon

SEQ ID NO: 1290 - DNA, 705 bp, Adenovirus D37
  MISC_FEATURE (1)..(705): D37.orf00043 L3 pVI
atggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcactgggcagttgttaagggaaaagctcaaagaccagaacttccagcaaaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaagggcgagaagcgaccgcggcccgacgcggaggagacaatcctgcaagtggacgagccgccctcgtacgaggaggccgtcaaggccggcatgcccaccacgcgcatcatcgcgccgctggccacgggtgtaatgaaacccgctacccttgacctgcctccaccacccacgcccgctccaccaaaagcagctccggttgtgcagccccctccggtggcgaccgccgtgcgccgcgtccccgcccgccgccaggcccagaactggcagagcacgctgcacagtatcgtgggcctgggagtgaaaagtctgaagcgccgccgatgctattga

SEQ ID NO: 1291 - DNA, 1005 bp, Adenovirus D37
  MISC_FEATURE (1)..(1005): D37.orf00045 L2 pV
atgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgtgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctaaagcccgtgaccctgcagcaggtgctgccccaggcagtgctgctgccgagccgcggggtcaagcgcgagggcgagagcatgtacccgaccatgcagatcatggtgcccaagcgccggcgcgtggaggacgtgctggacaccgtaaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgcgtccacttctaccgccgccacggctaccgagcctcccaggaggcgaagatggggcgccgccagccggctgatgcccaactacgtgttgcatccttccatcatcccgacgccaggctaccgcggcacccggtactacgccagccgcaggcgcccagccagcaaacgccgccgccgcaccgccacccgccgccgtctggcccccgcccgcgtgcgccgcgtgaccacgcggcggggccgctcgctcgttctgcccaccgtgcgctaccaccccagcatcctttaa

SEQ ID NO: 1292 - DNA, 591 bp, Adenovirus D37
  MISC_FEATURE (1)..(591): D37.orf00046 L2 pVII
atgtctattctcatctcgcccagcaataacaccggctggggtcttactaggcccagcaccatgtacggaggagccaagaaacgctcccagcagcaccccgtccgcgtccgcggtcacttccgcgctccctggggcgcttacaagcgggggcggacctctgctcctgccgccgtgcgcaccaccgtcgacgacgtcatcgactcggtggtcgccgatgcgcgcaactacacccccgccccctcgaccgtggacgcggtcatcgacagcgtggtggcagacgcgcgtgactatgccagacgcaagagccggcggcgacggatcgccaggcgccaccggagcacgcccgccatgcgcgccgcccgagctctgctgcgccgcgccagacgcacgggccgccgggccatgatgcgagccgcgcgccgcgctgccactgcacccacccccgcaggcaggactcgcagacgagcggccgctgccgccgccgcggccatctctagcatgaccagacccaggcgcggaaacgtgtactgggtgcgcgactccgtcacgggcgtgcgcgtgcccgtgcgcacccgtcctcctcgtccctga

SEQ ID NO: 1293 - DNA, 1560 bp, Adenovirus D37; identical to SEQ ID NO: 187
  MISC_FEATURE (1)..(1560): D37.orf00047 L2 penton

SEQ ID NO: 1294 - DNA, 1608 bp, Adenovirus D37
  MISC_FEATURE (1)..(1608): D37.orf00049 L1 pIIIa
atgcaacgcatcatggccctgacgacccgcaaccccgagtcctttagacaacagccgcaggccaacagactctcggccattctggaggcggtggttccttctcggaccaaccccacgcacgagaaggtgctggcgatcgtgaacgcgctggcggagaacaaggccatccgtcccgacgaggccgggctagtgtacaacgccctgctggagcgcgtgggccgctacaacagcacaaacgtgcagtccaacctggaccggctggtgacggacgtgcgcgaggccgtggcgcagcgcgagcggttcaagaacgagggcctgggttcgctggtggcgctgaacgccttcctggcgacgcagccggcgaacgtgccgcgcgggcaggatgattataccaactttataagcgcgctgcggctgatggtgaccgaggtgccccagagcgaggtgtaccagtcgggcccggactactttttccagacgagcagacagggcctgcagacggtgaacctgagtcaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagtggcagcgtgaaccgcaactcgtacctgggtcacctgctgacgctgtaccgcgaggccataggccaggcgcaggtggatgagcagaccttccaggagatcactagcgtgagccgcgcgctgggtcagaacgacaccgacagtctgagggccaccctgaacttcttgctgaccaatagacagcagaagatcccggcgcagtacgcgctgtcggccgaggaggagcgcatcctgagatatgtgcagcagagcgtagggctgttcctgatgcaggagggggccacccccagcgccgcgctggacatgaccgcgcgcaacatggaacctagcatgtacgccgccaaccggccgtttattaataagctgatggactacctgcaccgcgcggcgtccatgaactcggactactttaccaatgccatcttgaacccgcactggctcccgccgccggggttctacacgggcgagtacgacatgcctgaccccaacgacgggtttttgtgggacgacgtggacagcgcggtgttctcaccgaccttgcaaaagcgccaggaggcggtgcgcacgcccgcgagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggtcaataacgggatagagagtctggtggacaaactgaaccgctggaaaacctacgctcaggaccatagggaacctgcgcccgcgccgcggcgacagcgtcacgaccggcagcggggcctggtgtgggacgacgaggactcggccgacgatagcagcgtgttggacttgggcgggagcggtggggccaacccgttcgcgcatctgcagcccagactggggcgacggatgttttga

SEQ ID NO: 1295 - DNA, 1125 bp, Adenovirus D37
  MISC_FEATURE (1)..(1125): D37.orf00051 L1 52/55K protein
atgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacatccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcacagctgttcctggtggtgcagcacagcagggacaacgaggcgttcagggaggcactgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtatgtgcccatagacaaggaggtgaagatagacagcttttacatgcgcatggcgctcaaggtgctgacgctgagcgacgacctgggcgtgtaccgcaacgaccgcatccacaaggccgtgagcacaagccggcggcgcgagctgagcgaccgcgagctgatgctgagtctgcgccgggcgctggtaggaggcgccaccggcggtgaggagtcctactttgacatgggggcggacctgcattggcagccgagccgacgcgccttggaggccgcctacggtccagaggacttggatgaggaagaggaagaggaggaggatgcacccgttgcggggtactga

SEQ ID NO: 1296 - DNA, 1854 bp, Adenovirus D37
  MISC_FEATURE (1)..(1854): D37.orf00054 E2B pTP
atggactatttcctgcccctgcgcaacatctggaaccgcgtccgcgagttcccgcgcgcctccaccaccgccgccggcatcacctggatgtcccgctacctctacggctaccaccgactcatgcttgaggacctggccccgggcgcgccggccacccagcgctggccgctctaccgccagccgccgccgcactttctagtcggataccagtacctcgtgcgcacctgcaacgactatgtcttcgactcgcgcgccttctcgcggctcaggtactccgaggtcgtgcaacccggcctgcagaccgtcaactggtcgcttatggccaactgcacttacaccatcaacacaggggcctaccaccgcttcgtcgacatggacgacttccaggacaccctcacccgcgtgcaacaggccatcctcgccgagcgcgtcgtcgccgacctggcgctcgtgcagccgttcaggggcgtcggggtcacccgcatggaagactccgcctccgccagtgatgacatcgagaggctcatgcatgactactacaagaacctgagccggtgtcagggccaggcctggggcatggccgagcggctccgcatccagcaagcgggacccaaggacctggtcctcctcgccaccatccgccgcctcaaaaacgcctacttcaattacatcatcagcaaccgcaattctaacagcgtccacagggctgctacgtgtttgagcttaccttgcgactgcgattggctagacgctttcctcgaaagattctccgatccggtcgatctcgacgcgctcacgtgccctacaccgcaattgataagatgcattgtcagcgccctatcgctgcccaacggggacccaccccattaccgggagatgaccggcggcgtcttcacgctgcgtcctcgcgaacggggtcgcgccgtcaccgaaaccatgcgtcgccgccgcggggagatgatcgagcgcttcgtcgaccgtctcccggtgcgtcgccgtcgtcgtcgggccccgccaccaccaccgcccccagaggaagaaatagaagaagaggtcgtcatggaagaagaggaagaggaggaggcccccggggatttcgagcgcgaggtgcgcgccaccatcgccgaactcatcaggctcctggaagacgagctcacggtctcggcccgcaacgcccagtttttcaacttcgccgtggatttctacgaggccatggaaaggctggaggccattggcgacatcagcgaaatgcccctgcgccgctggattatgtacttcttcgtcaccgagcacatcgccaccaccctcaactacctcttccaacgcctgcgcaactatgccgtcttcgcgcggcacgtggagctcaacctcgcgcaggtggtcatgcgcgcgcgcgacgccgacggggacgtggtttacagccgcgtctggaacgagagcggcctgggcgccttctcgcagctcatgggtcgcatctcgaatgaccttgccgccaccgtagagcgcgcgggccgcggcgatctccaggaggaggaaatcgagcagttcatgtccgagatcgcctaccaggacaactcgggcgacgtgcaagagatcctgcgtcaggccgccgtcaatgacgccgagattgattctgttgaactgtctttcaggttcaaagtcacggggcccgtggtcttcacgcaaaggcggcagatccaggatgtcaaccgccgcgtcgtcgcgcacgccagcgctctcagggcgcagcaccgggacctgcccgagcgccacgccgacgtgcctctaccgccactgcccgcggggccggaaccgccgctgccgccgggagcgcgtccgcgacaccgcttctaa

SEQ ID NO: 1297 - DNA, 3267 bp, Adenovirus D37
  MISC_FEATURE (1)..(3267): D37.orf00056 E2B polymerase
gtggacacgaccaccaactcacccgtggagatcaagtaccatctgcatctcaagcacgccctcacccgcctctacgaggtcaacctcagaaccctgcccccggacctggatctccgcgacaccatggacagctcccaactgcgcgccctcgttttcgctctccgcccccgccgcgccgagatctggacctggctcccgcgcgggctcgtcagcctctccgtcctcgaggagccccagggtgagtcccacgcaggcgaacatgaaaaccaccagccagggccgccactcctgaagttcctcctcaagggacgcgctgtgtatctcgtggatgaggtacagcccgtgcagcgctgcgagtactgcggacgcttttacaagcatcagcacgagtgctcggttcgccggcgggatttctactttcatcacatcaacagccactcgaccaactggtggcaggaaatccagttcttcccaatcggctctcatcctcgcacggagcggctctttgtcacctacgatgtagaaacctacacctggatggggtccttcggcaagcagctcgtccccttcatgctggtcatgaaattctccggggaccccgagctggtcgccctcgctcgcgatctcgccgtgcgcttacgctgggatcgctgggagcgggaccccctcaccttctactgcgtcaccccagaaaagatggccgtgggccagcagttccgcctctttcgcgacgagctccagaccctcatggcccgcgagctctgggcttcattcatgcaagccaacccacatctccaggagtgggcgctcgagcagcacggcctgcaatgccccgaggacctcacctacgaggaactcaaaaagctgccgcacatcaaaggccgcccgcgattcatggaactctacatcgtcgggcacaacatcaacggcttcgacgagatcgtcctcgccgcccaggtcatcaacaaccgagcctccgttccgggccctttccgcatcacccgcaatttcatgccgcgggcaggcaagattctcttcaatgacgtcactttcgctctgcctaaccccctctcgaagaagcgcaccgatttcgagctctgggagcacggcggctgcgacgactcggatttcaagtaccagttcttgaaagtcatggttagggataccttcgccctgacgcacacctcgctccgcaaggccgctcaagcttacgccctccccgtggagaagggctgctgtccctacaaggccgtgaaccatttctacatgctgggctcttaccgtgcggacgatcgaggattcccgctccgggagtactggaaggatgacgaggagtacgccctcaaccgcgcgctgtgggagaagaaagaagaggcgggttatgacatcatccgtgaaacgctggactactgcgccatggacgtccttgtcaccgccgagctcgttgccaagctgcaagactcctacgcgcacttcatccgcgactcggtccgcttgccccacgcccactttaacatcttccaacggcccaccatctcctccaactcgcatgccatctttcgccagatcgtcttccgcgccgagcagccccagcgcaccaatctcggccccgctttcttggccccctcgcacgagttgtatgactatgtgcgcgccagcatccgcggggggcgctgttatcccacctacatcggcatcctctcggagcccatctatgtctacgacatctgcggcatgtacgcctccgccctcacgcatcccatgccctggggtccgcccctcaacccctacgagcgagcgctggccgcccgcgagtggcagatggccttggatgatgcatcctcaaaaatcgattattttgacaaggaactctgtccgggcatcttcaccatcgatgcggacccccctgacgagcatctgcttgatgtgctgcccccgttctgctcgcgcaagggcggacgcctctgctggaccaacgagcccctgcgcggcgaggtggccaccagcgtggacctggtcaccctgcataatcgcggctggcgcgtcaggatcgtgcccgacgagcgcaccaccgtcttcccagaatggaagtgtgtcgcgcgcgagtatgtccagctcaacatcgcggccaaggagcgcgccgaccgtgacaaaaatcagaccatgagatccatcgccaagcttctctccaacgccctctatggctcctttgccaccaagcttgacaataaaaaaatagtcttttctgaccagatggatgaaagtctcctaaaaagcattgcggcagggcaggccaacatcaaatcctcctcgtttctagaaactgacaacctgagtgccgaggtcatgcccgctctcgagagggaatacctaccccaacagctggcgctcgtggacagcgacgcggaagagagtgaggacgagcacagacccgcccccttttatacccccccgtcggggacccccggtcacgtggcctacacctacaagccaatcaccttcttggatgcggaggagggggacatgtgtctgcacacggtggaaaaggtggaccccctggtggacaacgaccgctacccctcgcacgtggcctcctttgtcttggcgtggacgcgcgcctttgtctcagagtggtccgagtttctctacgaggaggaccgcgggacgcccctgcaggacaggccaatcaagtccgtctacggggacacagacagcctgtttgtcaccgaacgcggacacagactcatggagacgcgaggtaagaagcgcatcaaaaagaacgggggaaaactggtttttgaccccgagcagcccgagctcacctggctcgtcgagtgcgaaaccgtctgcgcccactgcggagcggacgccttcgctcccgagtccgtctttctcgcacccaagctctacgccctgcaatccctcctctgtcccgcctgcgggcgctcttccaaaggcaagctccgtgccaagggccacgccgccgaggcccttaactacaagctcatggtcaactgctatctcgccgacgcgcagggcgaagaccgtgcccgtttcagcaccagcaggatgagtctcaagcgcacccttgcaagcgcccagcccggggcccaccccttcaccgtgacggagaccaccctcactcggaccctgagaccctggaaggacatgacgctggccgcgctggacgcccatcgtctcgtgccctacagtcgcagtcgtcccaacccccgaaacgaggaagtctgctggatcgagatgccgtag

SEQ ID NO: 1298 - DNA, 1047 bp, Adenovirus D37
  MISC_FEATURE (1)..(1047): D37.orf00057 pIVa2 IVa2
atgcccatggccgacgggctcaagcccctgaaaaactttgcttccctgcaagagctgctctcgctgggcggggaccgcctcctcggcgagctcgtccgggaaaacctccaagtgagagacatgctcaacgaggtggcccccctcctccgggacgacggcagctgcatctccttgaactaccacctgcaacccgtcatcggggtcatctacggcccgaccgggtgcggcaagtcccagctgttaagaaacctgctctcctcgcagctcatcacccccgccccggaaaccgtttttttcatcgccccgcaggtggacatgatccccccctccgagatgaaagcctgggagatgcagatctgcgaggggaacttcgccccggggcccgagggaacgatcgtcccccaatctggcacccttcgccccaaattcattaaaatgtcttatgatgatctcacccaggagcataattatgatgtctctgaccccagaaacgtttttgccaaagccgcagcccacgggcccattgccatcatcatggatgagtgcatggaaaacctgggcgggcacaagggcgtctccaaattcttccacgcattcccttccaagttgcatgataagttccccaagtgcacgggctacaccgttctggtggtcctgcacaatatgaacccccggcgggatctgggtggcaacatcgccaacctcaagatccaggccaaactgcacatcatctccccccgcatgcatccctcccagcttaaccgctttgccaacacctacaccaaggggctccccgtggccatcagtctcctcctcaaggacatcatccagcaccacgcccagcgcccctgctatgactggattatctacaacacgaccccagagcacgaggccatgcagtggtgctacctccacccccgggacgggctcatgcccatgtacctcaacatccaatcccacctctaccgggtcctggaaaaaatccaccgcactctcaatgatcgggagaggtggaccagggcctaccgcgcgcgaaaaaataaataa

SEQ ID NO: 1299 - DNA, 405 bp, Adenovirus D37
  MISC_FEATURE (1)..(405): D37.orf00059 pIX pIXprotein
atgaacgggaccggcggggccttcgaaggggggctttttagcccttatttgacaacccgcctgccgggatgggccggagttcgtcagaatgtgatgggatctacggtggatgggcgtccagtgcttccagcaaattcctcgaccatgacctacgcgaccgtggggagctcgtcgcttgacagcaccgccgcagccgcggcagccgcagccgccatgacagcgacgagactggcctcgagctatatgcccagcagcggtagcagcccctctgtgcccagttccatcatcgccgaggagaaactgctggccctgctggccgagctggaagccctgagccgccagctggccgccctgacccagcaggtgtccgatctccgcgagcaacagcagcagcaaaataaatga

SEQ ID NO: 1300 - DNA, 1488 bp, Adenovirus D37
  MISC_FEATURE (1)..(1488): D37.orf00060 E1B 55 kDa protein
atggagccagaacacccaactgagcaggggctacattctggacttcgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcttgtacccagagcttagcaaggtgctgacatccatggctaggggagtgaagagggagaggagcgatgggggcaataccgggatgatgaccgagctgacggccagcctgatgaatcgcaagcgcccagagcgcattacctggcacgagctacagatggagtgcagggatgagttgggcctgatgcaggataaatatggcctggagcagataaaaacacattggttgaacccagatgaggattgggaggaggccattaagaaatatgccaagatagccctgcgcccagattgcaagtacatagtgaccaagaccgtgaatattagacatgcctgctacatttcagggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttctttggcttcaacaatatgtgcgccgaggtctggggcgcttccaagatcaggggatgtaagttttatggctgctggatgggcgtggtcggaagacctaagagcgagatgtctgtgaagcagtgtgtgtttgagaaatgctacctgggagtctctaccgagggcaatgctagagtgagacactgctcttccctggatacgggctgcttctgcctggtgaagggtacggcctctctgaagcataatatggtgaagggctgcacagatgagcgcatgtacaacatgctaacatgcgactcgggggtctgtcatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggaaaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattag

SEQ ID NO: 1301 - DNA, 207 bp, Adenovirus D37
  MISC_FEATURE (1)..(207): D37.orf00063 E1A early E1A 12S
gtgtcagaggatgagtcatcaccctcagaagaaaaccacccgtgtccccctgagctgtcaggcgaaacgcccctgcaagtgcacaaacccaccccagtcagacccagtggcgagaggcgagcagctgttgaaaaaattgaggacttgttacatgacatgggtggggatgaacctttggacctgagcttgaaacgccccaggaactag

SEQ ID NO: 1302 - DNA, 579 bp, Adenovirus D37
  MISC_FEATURE (1)..(579): D37.orf00065 E1A early E1A 13S
atgagacacctgcgcctcctgtcttcaactgtgcctattaacatggccgcattattgctggaggactatgtgagtacagtattggaggacgaactacatccatctccatttgagctgggacctacacttcaggacctttatgatttggaggtagatgcccatgatgacgacccaaacgaagaggctgtgaatttaatatttccagaatctctgattcttcaggctgacatagccagcgaagctgtacctacaccacttcatacaccgactttgtcacccatacctgaattggaagaggaggacgagttagacctccgatgttatgaggaaggttttcctcccagcgattcagaggacgaacagggtgagcagagcatggctctaatctcagaatatgcttgtgtggttgtggaagagcattttgtgttggacaatcctgaggtgcccgggcaaggctgtagatcctgccagtaccaccgggataagaccggagacacaaacgcctcctgcgctctgtgttacatgaaaaagaacttcagctttatttacagtaagtggagtgaatgtgagagaggctga

SEQ ID NO: 1303 - DNA, 378 bp, Adenovirus D69
  MISC_FEATURE (1)..(378): D69.orf00002 E4 ORF1 protein
atggctgaatctctgtatgcttttatagatagtcctggagggattgctcccgtccaggaagggactagcaatagatataattttttttgccctgaatctttccacattcctccgcatggggtggtattgcttcacctaaaagtgagtgtgctggttcctactggatatcagggcagatttatggccttgaatgactaccatgccagggacatactaacccagtccgatgtgatttttgccggaagaagacaggaacttactgtgctgctttttaatcacacggaccgatttttgtatgtccgcaagggccacccagtgggtaccctgttgctggagagagtgatttttccttcagtgaaaatagccaccttagtttag

SEQ ID NO: 1304 - DNA, 309 bp, Adenovirus D69
  MISC_FEATURE (1)..(309): D69.orf00003 E4 ORF2 protein
atgattaaagaaaaactaccacgctttatcacttacattttggaaggcatcaccggagacacaaagagagcttattccagcatgcagtttttgggtgctagctttggagcattaaagttttcccttacgcttgccagtcccacgcttagccctggctctgaattgtcagctgtagtggcccaggacttaagtgactttttgcagctgacattgaggcgcgagctcagggcggagggcagaaccttattgaatcttgttgttttgaacacgctgcaggtggtggagcagcaggatctgtttctattatga

SEQ ID NO: 1305 - DNA, 354 bp, Adenovirus D69
  MISC_FEATURE (1)..(354): D69.orf00005 E4 13.6 K E4 ORF 3 13.6 kDa protein
atgaaggtctgcctgattatgaaagtggagggggcactgtgggagcttttccacatgtgcggagtggacttacaccaacaatttgtagagataatccaaggctggaaaaatgagaattacctggggatggtgcaggaatgtaacctgatgattgatgaaatcgatggagggccagcctttaatgtgattcttatgctggatgtacgcgtagagccactgctcgaagccacggtcgagcaccttgaaaatagagtgggttttgacctggctgtctgtttccaccagcacagcggcggggaacgctgtcacctgcgtgacttgcactttatcgtccttcgagaccgtttggaataa

SEQ ID NO: 1306 - DNA, 663 bp, Adenovirus D69
  MISC_FEATURE (1)..(663): D69.orf00007 E4 34.1 kDa protein
atgatcttgactccagaggaaataaaaattttaaaaagatgtatgtcagtgtgcctgtgccccgctaccctggacttggtgagagctcagatggtgagcgggtacgagcgctggatcctgcattgccactgttcatccccgggctccctgcagtgtcgggcgggaggcaccctgctggccgtgtggttcaggagagtcatttacgggtgcatgttcaaccagcgtttcccatggtaccgtcagattgtgaacagagacatgcccaaagagatcatgtatatgggcagtgtgttcatgaggggcaggcacctgatatactgccgcatctggtacgatggtcacgtgggttccatcatccccaacatgagttttggctggagcaccctgaattatggtctgctgaataacatggtgattatgtgctgcacttactgtgagaacatgagcgagatcaggatgcggtgctgtgcccgacgcaccaggagactgatgctgaaggctgtggggatcatagtcagagagacttgtgatcccgatcccatctgcagcagccgcaccgagccccggcggcagagactgctgagggcgctgatggagaggcacagacccatcctgttttccgaatatgaatctgtgcgttcttctcattccactagactgtga

SEQ ID NO: 1307 - DNA, 246 bp, Adenovirus D69
  MISC_FEATURE (1)..(246): D69.orf00008 E4 ORF6/7 protein
gtgaccttggactgtgaggcccgcttggatgacttttcagaggacggcttcatctcaatcaccgacccccgtttggctcgccaggaaactgtgtggattatagaccccaagtccagttcccgcactaatcagaacatttccctatttaaggccacccgtgctgagagaatcgtgtacactgtgaaatgggctggtggtgggagactgactacccgtgctggtgtaaaaatcaataaagatacataa

SEQ ID NO: 1308 - DNA, 1116 bp, Adenovirus D69; identical to SEQ ID NO: 158
  MISC_FEATURE (1)..(1116): D69.orf00009 L5 fiber

SEQ ID NO: 1309 - DNA, 150 bp, Adenovirus D69
  MISC_FEATURE (1)..(150): D69.orf00010 U protein
atgaaaattgtggaccaggaatttgacatccctttcaaggtgtggagaaagttcgccgcccgccggggactggagtaccagagctgggaggagggtaccgaggtgctgctaaacaactacaccagagacatactttcagatttcaagtaa

SEQ ID NO: 1310 - DNA, 393 bp, Adenovirus D69
  MISC_FEATURE (1)..(393): D69.orf00011 E3 14.7 kDa protein
atgactgacaaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctcctcaagaccctttgcggacttcgcgacctcctccccatgaactga

SEQ ID NO: 1311 - DNA, 390 bp, Adenovirus D69
  MISC_FEATURE (1)..(390): D69.orf00013 E3 RID-beta
atgcagactctgctcatactgctatccttcctctcccctgccctcgctgatgatgattactctaagtgcaaatttgtggagctatggaatttcttagactgctatgatgctaaaatggatatgccatcctattacttggtgattgtggggatagtcatggtctgctcctgcactttctttgccatcatgatctacccctgttttgatctcggctggaactctgttgaggcattcacatacacactagaaagcagttcactagcttccacgccgccacccacaccgcctccccgcagaaatcagtttcccatgattcagtacttagaagagccccctccccggcccccttccactgttagctactttcacataaccggcggcgatgactga

SEQ ID NO: 1312 - DNA, 276 bp, Adenovirus D69
  MISC_FEATURE (1)..(276): D69.orf00014 E3 RID-alpha
atgattcctaggttcttcctatttaacatcctcttctgtctattcaacgtgtgcgctgccttcgcggccgtctcgcacgcctcgcccgactgtcttgggcccttccccacctaccttctttttgccctgctcacctgcacctgcgtctgcagcattgtctgcctggtcgtcaccttcctgcagctcatcgactggtgctgcgcgcgctacaattatctccaccacagtcccgaatacagggacgagaacgtagccagaatcttaaggctcatttga

SEQ ID NO: 1313 - DNA, 852 bp, Adenovirus D69
  MISC_FEATURE (1)..(852): D69.orf00016 E3 CR1-gamma
atgaaggctttcacagcttgcgttctgattagcatagtcacattagtatcagctgattacaaacaagttcaagttagcagaggaggaaatattacattagatggaccattcgataatactacatggacaagatatcataatgatggacataaaaatggttggatgaaaatttgcacatggactggagcaacatataaatgtcacaataatggaagcattactatttttgctttcaacattacatccggagtttacaaagcagaagggtataaaaaagaggttagaacattttcatctagaaatcaaaaacatacaattgaagattctggagattatgaacaacaaaaaatatatctatataatctaacaataattgaagcgccaactactaaagcacccaccacagttagaacaaccacgcagacaactactagggaaacaacacatccaaccaccacagtcagtacaactcacactacacatctagacactacagtgcagaatactactttattgattgggtttttactaagaggaaatgaaagtactactgatcagacagaggctacctcaagtgccttcagcagcactgcaaatttaacttcgcttgcttcggtaaatgaaacgatcgtgccgatgatgtatggccaaccttactcaggtttggatattcaaattacttttctggttgtctgtgggatctttattcttgtggttcttttgtactttgtctgctgcaaagccagagaaaaatctaggaggcccatctacaggccagtaatcggggatcctcagcctctccaagtggaagggggtctaaggaatcttctcttctctttttcagtatggtga

SEQ ID NO: 1314 - DNA, 1269 bp, Adenovirus D69
  MISC_FEATURE (1)..(1269): D69.orf00017 E3 CR1-beta
atgaatactttgaccagtgtcgtgctgctctctcttcttgtagcttttagtcaggcaggatttcatactatcaatgctacatggtgggctaatgtaactttagtgggaccctcagatacgccagtcacatggtatgataaacagggaatgcagttctgtgatggaaatacagttaagaatcctcaaataagacatgagtgtaatgagcaaaaccttacactaattcatgtgaacaaaacccatgaaaggacatacatgggttataatagacagagtactcataaggaagactataaagtcatagttataccgcctcctcctgctactgtaaagccacagtcaggtccagagtatgtatatgttaatatgggagagaacaaaaccttagttggacctccaggaataccagttacttggtatgacggagaaggaaataaattctgcgatggagaaaaagttgaacatgcagaatttaatcatacatgtgacgagcaaaatcttacactgttgtttataaatcttacacatgatggggcttatcttggctataatcaccagggaactaaaagaacttggtatgaggttgtagtgacagatggttttccaaaatcaggggagatgaaaatcgaagatcagagtagacaaacagaacaaaaacaaaatgagcataaacagggtgggcagaaacaggaggggcaaaaagagacaagtcaaaagaaagataatgacaaacagaaggcgacacacaggaggccatcaaaactaaagccgcacacacctgaagcaaaactgattacagtttctagtgggtctaacttaacattacttgggccagatggaaaggtcacttggtatgatgatgatttaaaaagaccatgcgagcctgggtataagttagggtgtaagtgtgacaatcaaaacctaacgctaatcaatgtaactaaactttatgagggagtttactatggtactaatgacagaggtaacagcaaaagatacagattaaaagtaaacactactaattctcaaagtgtgaaaattcagccatacaacaggtctactactcctgatcagaaacacagatttgaattgcaaattgattctaatcaagacaatgacaaaattccatcaaccactgtggcaatcgtggtgggagtgattgcgggcttcataactataatcattgtcattctgtgctacatctgctgccgcaagcgtcccagggcatacaatcatatggtagacccactacttagcttctcttactga

SEQ ID NO: 1315 - DNA, 306 bp, Adenovirus D69
  MISC_FEATURE (1)..(306): D69.orf00018 E3 gp 17.5 kDa protein
atgggaaattcatgggtgggcgattgggaaccaggagatgagcagaactacacggtcactgtccatggtagcgatgggaatcacactttcggtttcaaattcatttttgaagtcatgtgtgatatcacactgcatgtggctagacttcatggcttgtggccccctaccaaggagaacatggttgggttttctttggcttttgtgatcatggcctgctttatgtcaggtctgctggtaggggctttagtatggttcctgaagcacaagcctaggtatggaaatgaggagaaggaaaaattgctataa

SEQ ID NO: 1316 - DNA, 570 bp, Adenovirus D69
  MISC_FEATURE (1)..(570): D69.orf00019 E3 CR1-alpha
gtgctgagtttaataaaagctaaactcctacaatactctgggatcccgtgtcgtcgcactcgcaacgagatcttcaacctcaccaaccagactgaggtaaaactcaactgcagaccggggggcaaatacatcctctggctctttgaaaacacttccttcgcagtctccaacgcctgcgccaacgacggtattgaaatacccaacaaccttaccagtggactaacttacactaccagaaagactaagctagtactctacaatccttttgtagagggaacctaccactgccagagcggaccttgcttccacactttcactttggtgaacgttaccgacagcagcacagtcgctccagaaacatctaacctttttgatactaacactcctaaaaccggaggtgagctctgggttccctctttaacagaggggggtaaacatattgaagcggttgggtatttgattttaggggtggtcctgggtgggtgcatagcggtgctgtattaccttccttgctggatcgaaatcaaaatctttatctgctgggtcatacattgttgggaggaaccatga

SEQ ID NO: 1317 - DNA, 321 bp, Adenovirus D69
  MISC_FEATURE (1)..(321): D69.orf00020 E3 12.2 kDa protein
atgtcccatgctgactcggctgagctcgctcggttgaggcatctggaccactgccgccgcctgcgctgcttcgcccgggagagctgcggactcatctactttgagtttcccgaggagcaccccaacggccctgcgcacggagtgcggatcaccgtagagggcaccgccgagtctcacctggtcaggttcttcacccagcaacccttcctggtcgagcgggaccggggcgccaccacctacaccgtctactgcatctgtcctaccccgaagttgcatgagaatttttgttgtactctgtgtgctgagtttaataaaagctaa

SEQ ID NO: 1318 - DNA, 684 bp, Adenovirus D69
  MISC_FEATURE (1)..(684): D69.orf00021 L4 pVIII
atgagcaaggagattcccaccccttacatgtggagctatcagccccagatgggcctggccgcgggcgcctcccaggactactccacccgcatgaactggctcagtgccggcccctcgatgatctcacaggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagcttaacgacgagttggtgagctcttcaatcggtctgcgaccggacggagtgttccaactagccggagccgggagatcctccttcactccccaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgatgcagtgagagaagcggtggacggctacgactga

SEQ ID NO: 1319 - DNA, 219 bp, Adenovirus D69; identical to SEQ ID NO: 912
  MISC_FEATURE (1)..(219): D69.orf00022 L4 20 kDa protein

SEQ ID NO: 1320 - DNA, 186 bp, Adenovirus D69; identical to SEQ ID NO: 949
  MISC_FEATURE (1)..(186): D69.orf00023 L4 22 kDa protein

SEQ ID NO: 1321 - DNA, 2172 bp, Adenovirus D69
  MISC_FEATURE (1)..(2172): D69.orf00025 L4 100 kDa protein
atggaggagcagccgcgtaagcaggagcaggaggaggacttaaccacccacgagcaacccaaaatcgagcaggacctgggcttcgaagagccggctcgtctagaacccccacaggatgaacaggaggagaccgacgctgggctcgagcatggctacctgggaggagaggaggatgtgctgctgaaacacctgcagcgccagtccatcatcctccgggacgccctggccgaccggagcgaaacccccctcagcgtcgaggagctaagtagggcctacgagctcaacctcttctcgccgcgcgtgccccccaaacgccagcccaacggcacatgcgagcccaacccgcgtctcaacttctaccccgtctttgcggtccccgaggccctcgccacctatcacatctttttcaagaaccaaaagatccccgtctcctgccgcgccaaccgcacccgcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtag

SEQ ID NO: 1322 - DNA, 1473 bp, Adenovirus D69
  MISC_FEATURE (1)..(1473): D69.orf00027 E2A DNA-binding protein
atggccggcggcagtcaggacgtgcgccggttcatggagcgagaggccactccgccccggggccacgggtcggcgcgctatccgccggagcaggagaggagcccctcgccgccaccacctcctctgcccaccaagcgccgaaagtatcagcgggtgggctccgggtcttccgaggaggacgtggttcccgtggacagccctccaaaaaagaagcaagccaggaagaccaagcatgtgaccaaggtagaccccgacgaagagatgccccaggaagatgccgtgatcgtgggagtgggattcagccagccgccggttctgttgaaggaaggcaaggacggaaaacgcatcgtcgagcccgcgacacccggtgtcctgaacgtgcgcaaccccctgagtctgcctctggtctcgtcctgggagaagggcatggataccatgaacgtgctgatggaacgttaccgcgtcgacagcggcctgcgcgatgcttacaagctcatgcccgagcagaccgagatcttccaaaagatgtgccagacctggatgaacgaggaggcccgcggtctgcaactgaccttcaccactcagaaaacctttagcaccataatgggccgcatgttgcaaggttacatcttcagccacagcgggatcgcgcacaagaactgggagtgcaccggctgcgccctgtgggaccacggctgcaccgaggtggaaggtcagctcaagtgtctgcatggaacggtgatgatccacaaggaccacgtggtggagatggatgtgaccagtgagaacgggcagcgcgcgttgaaggagcaacccagcaaggccaaggtgacccagaaccgctggggccggagcgtggtgcaactgaccagccatgacgcgcgctgctgcgtgcaggatgccggatgcgggaataaccagttcagcgggaagagctgcggcctgtttttcagcgagggggccaaggcccagcaagctttcaagcagatcgcggcctttgtcaaggccctctacccgaatatgcagcgcggcgcgggaatgatgctaatgcccgttcactgcgagtgtaaccacaagcctcagagcgtgcccttcctgggccgccagctgtgcaagatgaccccgttcggcctgagcaacgccgaggacctggacaaggatcagatcagcgacaagagcgtgcttgccagtgtgaagtaccccagtctgatggtgttccagtgctgcaaccccgtgtaccgcaactcgcgcgcgcaaagcaccggccccaactgcgatttcaagatctccggcccggacatgctgggcgccctgcagatgagccggcgcatgtggagcgagaccttccccgagaccccagtgcccaaactggtgatccccgagttcaagtggcagcccaagtaccagtaccgcaacgtggccctccccagcgcggcgcacaacgacgagcgcgagaacccctttgacttttaa

SEQ ID NO: 1323 - DNA, 630 bp, Adenovirus D69
  MISC_FEATURE (1)..(630): D69.orf00028 L3 protease
atgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgcctttggctggaacccgcgctcgcgcacctgctacatgttcgacccctttgggttctcggaccgccggctgaagcagatttacagcttcgagtacgaggccatgctacgccgcagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctacccaccctccggcgcaaccaggagcagctctaccgcttcctcgcgcgccactccccttactttcgatcccaccgcgccgccatcgaacacgccaccgcttttgataaaatgaaacaactgcgtgtatctcaataa

SEQ ID NO: 1324 - DNA, 2856 bp, Adenovirus D69; identical to SEQ ID NO: 218
  MISC_FEATURE (1)..(2856): D69.orf00031 L3 hexon

SEQ ID NO: 1325 - DNA, 705 bp, Adenovirus D69
  MISC_FEATURE (1)..(705): D69.orf00032 L3 pVI
atggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaagctcaaagaccagaacttccagcagaaggtggtggacgggctggcctcgggcattaacggggtggtggacatcgcgaaccaggccgtgcagcgcgagataaacagccgcctggacccgcggccgcccacggtggttgagatggaagatgcaactcttccgccgcccaagggcgaaaagcggccgcggcccgacgcggaggagacgatcctgcaggtggacgagccgccctcgtacgaggaggccgtgaaggccggcatgcccaccacgcgtatcatcgcgccgctggccacgggtgtaatgaaacccgccacccttgacctgcctccaccacccacgcccgctccaccgaaggcagctccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattga

SEQ ID NO: 1326 - DNA, 225 bp, Adenovirus D69
  MISC_FEATURE (1)..(225): D69.orf00033 L2 pX core protein L2 pX
atggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgattccgggcatagcttccgttgcgctgcaggcgtcgcagcgccgttga

SEQ ID NO: 1327 - DNA, 999 bp, Adenovirus D69
  MISC_FEATURE (1)..(999): D69.orf00035 L2 pV
atgtcaaagcgcaaaatcaaggaggagatgctccaggtcgtcgccccggagatttacggacccccggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggccaggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgtctccacttctaccgccgccacggccaccgagcctcccaggaggcgaatatggggcgccgccagccggctgatgcccaactacgtgttgcatccttccatcatcccgacgccgggctaccgcggcacccggtactacgccagccgcaggcgcccagccagcaaacgccgccgccgcaccaccacccgccgccgtctggcccccgcccgcgtgcgccgcgtaaccacgcgccggggccgctcgctcgttctgcccaccgtgcgctaccaccccagcatcctttaa

SEQ ID NO: 1328 - DNA, 588 bp, Adenovirus D69
  MISC_FEATURE (1)..(588): D69.orf00036 L2 pVII
atgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttctaccgccgccgccgtgcgcaccaccgtcgacgatgtcatcgactcggtggtcgccgatgcgcgcaactatacccccgccccctccaccgtggacgcggtcatcgacagcgtggtggccgacgcgcgcgactatgccagacgcaagagccggcggcgacgaatcgccaggcgccaccggagtacgcccgccatgcgcgccgcccgggctctgctgcgccgcgccagacgcacgggccgccgggccatgatgcgagccgcgcgccgcgccgccactgcaccccccgcaggcaggactcgcagacgagcggccgccgccgccgccgcggccatttctagcatgaccagacccaggcgcggaaacgtgtactgggtgcgcgactccgtcacgggcgtgcgcgtgcccgtgcgcacccgtcctcctcgtccctga

SEQ ID NO: 1329 - DNA, 1560 bp, Adenovirus D69; identical to SEQ ID NO: 188
  MISC_FEATURE (1)..(1560): D69.orf00038 L2 penton

SEQ ID NO: 1330 - DNA, 1695 bp, Adenovirus D69
  MISC_FEATURE (1)..(1695): D69.orf00041 L1 pIIIa
atgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactttcggctattctggaggcggtggtcccctctcggaccaaccccacgcacgagaaggtgctggcgatcgtgaacgcgctggcggaaaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgttggtggcgctgaacgccttcctggcgacgcagccggcgaacgtgccgcgcgggcaggacgattataccaactttatcagcgcgctgcggctgatggtgaccgaggtgccccagagcgaggtgtaccagtcgggcccggactactttttccagactagcagacagggcctgcagacggtgaacctgagccaggctttcaagaatctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggtcacctgctgacgctgtaccgcgaggccataggccaggcgcaggtggacgagcagaccttccaggagatcactagtgtaagccgcgcgctgggtcagaacgacaccgacagtcttagagccaccctgaacttcttgctgacaaatagacagcagaagattccggcgcagtacgcgctgtcggccgaggaggagcgcatcctgagatatgtgcagcagagcgtagggcttttcctgatgcaggagggggccacccccagcgccgcgctggacatgaccgcgcgcaacatggaacctagcatgtacgccgccaaccggccgtttatcaataagctgatggactacctgcaccgcgcggcgtccatgaactcggactactttaccaatgccattttgaacccgcactggctcccgccgccggggttctacacgggcgagtacgacatgcctgaccccaacgacgggtttttgtgggacgacgtggacagcgcggtgttctcaccgaccttgcaaaagcgccaggaggcggtgcgcacgcccgcgagcgagggcgcggtgggtcggagcccctttcctagcttagggagtttgcatagcttgccgggctcggtgaacagcggcagggtgagccggccgcgcttgctgggcgaggacgagtacctgaacgattcgctgctgcagccgccgcgggtcaagaacgccatggccaataacgggatagagagtttggtggacaaactgaaccgctggaagacctacgctcaggaccatagggagcctgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcggcggatgttttga

SEQ ID NO: 1331 - DNA, 129 bp, Artificial Sequence
  D69.orf00043 hypothetical protein
gtgaccaagtcccgctcgccgcggccgtccgcgaaccgggttctgccgcgactcaaccctggcgatgcttctccagactacgggcgcgagccactgcccgacagggttttcggccgctttcaagtctag

SEQ ID NO: 1332 - DNA, 1125 bp, Adenovirus D69
  MISC_FEATURE (1)..(1125): D69.orf00044 L1 52 kDa protein
atgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgagtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacgggcatcagccccgcgcgcgctcacgtggcggcggccaatctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctaacggcgcagctgttcctggtggtgcagcacagcagggacaacgaggcgttcagggaggcgctgctgaacatcgccgagcccgagggtcgctggctgctggagctgatcaacatcttgcagagcatcgtagtgcaggagcgcagcctgagcctggccgagaaggtggcggcgatcaactactcggtgttgagcctcggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctcatgctgagtctgcgccgggcgctggtagggggcgccgccggcggcgaggagtcctacttcgacatgggggcggacctgcattggcagccgagccggcgcgccttggaggccgcctatggtccagaggacttggatgaggaagaggaagaggaggaggatgcacccgttgcggggtactga

SEQ ID NO: 1333 - DNA, 1854 bp, Adenovirus D69
  MISC_FEATURE (1)..(1854): D69.orf00047 pTP
atggactatttcctgccgctgcgcaacatctggaaccgcgtccgcgagttcccgcgcgcctccaccaccgccgccggcatcacctggatgtcccgctacgtctacggctaccaccgcctcatgctcgaggacctggccccgggcgcgccggccacccagcgctggccgctctaccgccagccgccgccgcactttctagtcggataccagtacctcgtgcgcacctgcaacgactacgtattcgactcgcgcgccttctcgcggctcaggtactcggaggtcgtgcagcccggcttgcagaccgttaactggtcgctcatggccaactgcacctacaccatcaacacaggggcctaccaccgcttcgtcgacatggacgacttccaggacaccctcacccgcgtgcaacaggccatcctcgccgagcgcgtcgtcgccgacctggcgctcgtgcagccgctcaggggcgtcggggtcacccgcatggaagactctgcctccgccagtgatgacattgaaaggctcatgcatgactactacaagaacctgagccggtgtcagggccaggcctggggcatggccgagcggctccgcatccagcaagcgggacccaaggacctggtcctcctcgccaccatccgccgcctcaaaaacgcctacttcaattacatcatcagcaaccgcaattctaacagcgtccacagggctgctacgtgtttgagcttaccttgcgactgcgattggctagacgctttcctcgaaagattctccgatccggtcgatctcgacgcgctcacgtcccctacaccgcaattgataagatgcatcgtcagcgccctctcgctgcccaacggggacccgccccattaccgggagatgaccggcggcgtcttcacgctgcgtcctcgcgaacggggtcgcgccgtcaccgaaaccatgcgtcgccgccgcggggagatgatcgagcgcttcgtcgaccgtctcccggtgcgtcgccgtcgtcgtcgcgccccgccaccaccaccgcccccagaggaagaaatagaagaagaggtcgtcatggaagaagaggaagaggaggaggcccccggggatttcgagcgcgaggtgcgcgccaccatcgccgagctcatccggctcctggaagacgagctcacggtctcggcccgcaacgcccagtttttcaacttcgccgtggacttctacgaggccatggaaaggctggaggccatcggcgacatcagcgagatgcccctgcgccgctggatcatgtacttcttcgtcaccgagcacatcgccaccaccctcaactacctcttccaacgcctgcgcaactacgctgtcttcacgcgccacgtggagctcaacctagcgcaggtggtcatgcgcgcgcgcgacgccgacggggacgtggtctacagccgcgtctggaacgagagcggcctgggcgccttctcgcagctcatgggtcgcatctccaacgacctcgccgccaccgtcgagcgcgcgggccgcggcgatctccaggaggaggagatcgagcagttcatgtccgagatcgcctaccaggacaactcgggcgacgtgcaagagatcctgcgtcaggccgccgtcaatgacgccgagattgattctgttgaactgtctttcaggttcaaagtcacggggccagtggtcttcacacagaggcggcagatccaggatgtcaaccgccgcgtcgtcgcgcacgccagcgctctcagggcgcagcaccgggacctgcccgagcgccacgccgaagtgcctctgccgcccctgcccgcggggccggaaccgccgctgccgccgggagcgcgtccgcgacaccgcttctaa

SEQ ID NO: 1334 - DNA, 3300 bp, Adenovirus D69
  MISC_FEATURE (1)..(3300): D69.orf00048 E2B DNA polymerase
gtggccccgcgcagctacgggctcatgcaatgcgtggacacggccaccaactcacccgtagaaatcaagtaccatctgcatctcaagcacgccctcacccgcctctacgaggtcaacctcagaaccctgccccctgacctggatctccgcgacaccatggacagctcccaactgcgcgcccttgtcttcgctctccgcccccgccgcgccgagatctggacctggctcccgcgcgggctcgtcagcctctccgtcctcgaggagccccagggtgagtcccacgcaggcgaacatgaaaaccaccagccagggccgccactcctgaagttcctcctcaagggacgcgctgtgtatctcgtggatgaggtacagcccgtgcagcgctgcgagtactgcggacgcttttacaagcatcagcatgagtgctcggttcgccggcgggatttctactttcatcacatcaacagccactcgtccaactggtggcaggaaatccagttcttcccaatcggctctcatcctcgcacggagcggctctttgtcacctacgatgtagaaacctacacctggatggggtccttcggcaagcagctcgtccccttcatgctggtcatgaaattctcgggggaccccgagctggtcgccctcgctcgcgatctcgccgtgcgcttacgctgggatcgctgggagcgtgaccccctcaccttctactgcgtcaccccagaaaagatggccgtgggccagcagttccgcctctttcgcgacgagctccagaccctcatggcccgcgagctctgggcttccttcatgcaagccaacccacatctccaggagtgggcgctcgagcagcacggcctgcaatgccccgaggacctcacctacgaggaactcaaaaagctgccgcacatcaaaggccgcccgcgattcatggaactctacatcgtcgggcacaacatcaacggcttcgacgagatcgtcctcgccgcccaggtcatcaacaaccgagcctccgtcccgggccctttccgcatcacccgcaatttcatgccgcgggcaggcaagattctcttcaatgacgtcactttcgctctgcctaaccccctctcgaagaagcgcaccgatttcgagctctgggagcacggcggctgcgacgactcggacttcaagtaccagttcttgaaagtcatggtcagggacaccttcgccctgacgcacacctcgctccgcaaggccgctcaagcttacgccctccccgtggagaagggctgctgtccctacaaggccgtgaaccatttctacatgctgggctcttaccgtgcggacgatcgaggattcccgctccgggagtactggaaggatgacgaggagtacgccctcaaccgcgagctatgggagaagaaaggagaggcgggttatgacatcatccgcgaaacactggactactgcgccatggacgtcctcgtcaccgccgagctcgtcgccaagctgcaagactcctacgcgcacttcatccgcgactcggtccgcctgccccacgcccactttaacatcttccaacggcccaccatctcctcaaactcgcatgccatctttcgccagatcgtcttccgcgccgagcagccccagcgcaccaatctcggccccgccttcttggccccctcgcacgagttgtatgactacgtgcgcgccagcatccgcggggggcgctgttatcccacctacatcggcatcctctcggagcccatctatgtctacgacatctgcggcatgtacgcctccgccctcacacatcccatgccttggggtccgcccctcaacccctacgagcgagcgctggccgcccgcgagtggcagatggccttggatgatgcatcctcaaaaatcgattattttgacaaggaactctgtccgggcatcttcaccatcgatgcggacccccccgacgagcacctcctggatgtgctgcccccgttctgctcgcgcaagggcggcagactctgctggaccaacgagcccctgcgcggcgaggtggccaccagcgtggacctggtcaccctgcataaccgcggctggcgcgtcaggatcgtgcccgacgagcgcaccaccgtcttccccgaatggaagtgcgtcgcgcgcgagtatgtccagctcaacatcgcggccaaggagcgcgccgaccgtgacaaaaatcagaccatgagatccatcgccaagcttctctccaacgccctctatggctccttcgccaccaagcttgacaataaaaaaattgtcttttctgaccagatggatgaaagtttactcaaaagcatcgcggcagggcaggccaacatcaaatcctcctcgtttctagaaactgacaacctgagtgccgaggtcatgcccgctctcgagagggaatacctaccccaacagctggcgctcgtagacagcgacgcggaagagagtgaggacgagcacagacccgcccccttttatacccccccgtcggggaccccaggtcacgtggcctacacctacaagccaatcaccttcttggatgcggaggagggggacatgtgtctgcataccgtggaaaaggtggaccccctggtggacaacgaccgctacccctcgcacgtggcctcctttgtcttggcgtggacgcgcgcctttgtctcagagtggtccgagtttctctacgaggaggaccgcgggacgcccctgcaggacaggcccatcaagtccgtctacggggacacagacagcctgtttgtcaccgaacgcggacacagactcatggagacgcgaggtaagaagcgcatcaaaaagaacgggggaaaactggtttttgaccccgatcaccccgagctcacctggctcgtcgagtgcgagaccgtctgcgcccactgcggagcggacgccttcgcccccgagtccgtctttctagcgcccaagctctacgccctgcaatccctcctatgtcccgcctgcgggcgctcttccaaaggaaagctccgcgccaagggccacgccgccgaggccctcaactacgagctcatggtcaactgctatctcgccgacgcgcagggcgaagaccgtgcccgtttcagcaccagcaggatgagtctcaagcgcacccttgcaagcgcccagcccggggcccacccattcaccgtgacggagaccaccctcactcggaccctgagaccctggaaggacatgacgctggccgcgctggacgcccatcgtctcgtgccctacagtcgcagtcgtcccaacccccgaaacgaggaagtctgctggatcgagatgccgtag

SEQ ID NO: 1335 - DNA, 1047 bp, Adenovirus D69
  MISC_FEATURE (1)..(1047): D69.orf00049 pIVa2 IVa2
atgcccatggccgacggactcaagcccctgaaaaactttgcttccctgcaagagctcctctcgctgggcggggaccgcctcctcggcgagctcgtccgggaaaacctccaagtcagagacatgcttaacgaggtggcccccctcctccgggacgacggcagctgcatctccttgaactaccacctgcaaccagtcatcggggtcatctacggtccgaccgggtgcggcaagtcccagctgctgagaaacctcctctcctcgcagctcatcacccccgccccggaaaccgtttttttcatcgccccgcaggtggacatgattcccccctccgagatgaaagcctgggagatgcagatctgcgaggggaacttcgccccgggccccgagggaaccatagtcccccaatctggcaccctccgccccaaattcattaaaatgtcttatgatgatctcacccaggagcataattatgatgtctctgaccccagaaacgtctttgccaaagccgcagcccacgggcccattgccatcatcatggatgagtgcatggaaaacctgggcgggcacaagggcgtctccaaattcttccacgcattcccttccaagttgcatgacaagttccccaagtgcacaggctacaccgtcctggtggtcctgcacaacatgaacccccggcgggatctgggcggcaacatcgccaacctcaagatccaggccaaactgcacatcatctccccccgcatgcatccctcccagctcaaccgttttgccaacacctacaccaaggggctccccgtggccatcagtctcctcctcaaggacatcatccagcaccacgcccagcgcccctgctatgactggatcatctacaacacgaccccagagcacgaggccatgcagtggtgctacctccacccccgggacgggctcatgcccatgtacctcaacatccaatcccacctctatcgggtcctggaaaaaatccaccgcactctcaatgatcgggagaggtggaccagggcctaccgcgcgcgaaaaaataaataa

SEQ ID NO: 1336 - DNA, 402 bp, Adenovirus D69; identical to SEQ ID NO: 1074
  MISC_FEATURE (1)..(402): D69.orf00053 IX pIX

SEQ ID NO: 1337 - DNA, 1488 bp, Adenovirus D69; identical to SEQ ID NO: 1075
  MISC_FEATURE (1)..(1488): D69.orf00055 E1B 55 kDa protein

SEQ ID NO: 1338 - DNA, 207 bp, Adenovirus D69; identical to SEQ ID NO: 1112
  MISC_FEATURE (1)..(207): D69.orf00059 E1A 14.8 kDa protein

SEQ ID NO: 1339 - DNA, 537 bp, Adenovirus D69
  MISC_FEATURE (1)..(537): D69.orf00060 E1A 28 kDa protein
atggccgcattattgctggaggattatgtgagtacaatattggaggacgaactgcatccatctccattcgagctgggacctacacttcaggacctatatgatttggaggtagatgcccatgatgacgacccgaacgaagaggctgtgaatttaatatttccagaatctctgattcttcaggctgacatagccagcgaagctgtacctacaccacttcatacaccgactctgtcacccatacctgaattggaagaggaggacgagctagacctccgatgttatgaggaaggttttcctcccagcgattcagaggacgaacagggtgagcagagcatgactctaatctcagaatatgcttgtgtggttgtggaagagcattttgtgttggacaatcctgaggtgcccgggcaaggctgtagatcctgccagtaccaccgggataagaccggagacacgaacgcctcctgcgctctgtgttacatgaaaaagaacttcagctttatttacagtaagtggagtaaatgtgagagagactga

SEQ ID NO: 1340 - DNA, 375 bp, Adenovirus E4
  MISC_FEATURE (1)..(375): E4.orf00001 E4 ORF1 protein
atggacgctcaggttttgtatgtgtttctggagggagcgggggctttgctgcctgtgcagaaggggagtaattacattttttacgcacctgccaattttgtgcttcatccgcatggggtcgctttgctggaattaagattaagcattgtagtgcctcaaggctttataggtcgctttttttcactcacggacgccaatgttcccggagtgtatgcttcttctcgaatcatccatgccggccaccgggaaggtctgtcggtgatgctttttaatcataatgtcagcttctacaatggtcgcgccggagaccctgtagcctgcctggtgttggaaagagtgatttatccacctgttcgccaggctagcatggtttaa

SEQ ID NO: 1341 - DNA, 390 bp, Adenovirus E4
  MISC_FEATURE (1)..(390): E4.orf00003 E4 ORF2 protein
atgctggaacgtactccttgcacttattccatcgttgttcctgaggctctaaacgtgcacctagacgacttttcttttgttaattttcttaaaaattgcttgcctgattttctgtccagttatctggaagatatcaccgggtctagccagcatgcttatttcaatcttacatttggcaatgctcactggggaggacttcgctttatctgtaatgtggcttgcccttctcttgttcctggtggtcctatggctaaaaatttcggagaagatatgaatgagtacatacagttactgctaagggaggagcttagggattgcggcagagcaattgatattccacttgttaatctactacaggtgaaccaggagcagaatctgttggaattatga

SEQ ID NO: 1342 - DNA, 336 bp, Adenovirus E4
  MISC_FEATURE (1)..(336): E4.orf00004 E4 ORF3 protein
atgccggtggagggcgctctgcgcgagctttttatcatggctggcttggatttacctcaggaactaatacgaatcattcaaggctggaaaaatgaaaattatctaggcatggtgcaggagtgtaatatgatgattgaggaattagaaaacgctcccgctttcgctgtcctcttgtttctggatgtgcgcgtggaggctttgctggaagccaccgtggaacatctcgagaaccgtgttacctttgacctggctgttattttccaccaacacagtgggggcgagaggtgccacctccgggacctgcattttgaagtgttccgagaccgtttggaataa

SEQ ID NO: 1343 - DNA, 369 bp, Adenovirus E4
  MISC_FEATURE (1)..(369): E4.orf00006 E4 ORF4 protein
atggttcttcctgttcttccctcccccgccgtcaccgaaacccaacaaaattgcatcatctggctgggtttggcccattccaccgtggttgatgtaatcagagccatcagggcggatgggattttcatcacccaagaggctcaggagatactgcacgttctgagggagtggctgttctataacttcaacattgagcgctcgaagcgccgagaccgtcgccgacgagcggtgtgcagtgcccggaccaggttctgctttgtgaaatacgaaaatgtccggaaacagctccatcatgacacgatccagaacacgattagcgttatctcgccatcatccgtaccaaccgccggccaccttacctcgctgtga

SEQ ID NO: 1344 - DNA, 654 bp, Adenovirus E4
  MISC_FEATURE (1)..(654): E4.orf00008 E4 34K protein
atggtcctgacccccgaggaattgagagtgctgaagacatgcatgagcgtgtgcctgtgctgtgccaacatagacttgtttagttcccagttgatccacggtcgcgagcggtgggtgatccactgccattgccagaacccggggtccctgcgctgcatggcgggcgggacggtacttgccatctggttccgcagaattatccagggctgcatgttcaaccagcgggtgatgtggtaccgggaggtggtgaacctgcacatgcccaaggagatcatgtacatgggcagtgtgttctggaggggacgccacctgatttacatcaggatctggtacgatggacatgtgggcagcatagttccacaaatgagttttggctggagcacgttgaactatggactgttgaacaacttggtggtgctgtgctgcacgtactgctccgacctgagtgagatccgcatccgctgctgcgcccgccgtaccaggcgactgatgctcagggccattggcatcatgcgcagggagtccctggacccggaccccttgagtagcagcttgacggagcggcgcagacagcgactgctgcggggcctgatgcgccacaaccgcccgatcccgtttgcggattatgattctcatcgctcttattccagataa

SEQ ID NO: 1345 - DNA, 246 bp, Adenovirus E4
  MISC_FEATURE (1)..(246): E4.orf00009 E4 ORF6/7 protein
gtgattccaatcaccgaggacagccctcagctgttgaactgtgaggtgcagatgcaggagtgcccggagggtttcatctccttgaccgacccgagactgtctcgctctgaaactgtgtggaatgtggagatcaaaaccatgtccattaccaatagcattcagatgtttaaggctgtgcgtggggagaggatagtgtattccatgagatgggagggtggagggaaaataactactcgaatcctgtga

SEQ ID NO: 1346 - DNA, 1278 bp, Adenovirus E4; identical to SEQ ID NO: 159
  MISC_FEATURE (1)..(1278): E4.orf00011 L5 fiber

SEQ ID NO: 1347 - DNA, 156 bp, Adenovirus E4
  MISC_FEATURE (1)..(156): E4.orf00012 U protein
atgaagattgagggacaggaggaatttgacatccccttcagagtgtggaggaagtttgcagcccgccggggcctgcagtaccagagctgggaagaggggagcgaagtgctgctgacagaaaacatggacagagacctggtttcagatttcaagtaa

SEQ ID NO: 1348 - DNA, 402 bp, Adenovirus E4
  MISC_FEATURE (1)..(402): E4.orf00013 E3 14.7K protein
atgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaa

SEQ ID NO: 1349 - DNA, 420 bp, Adenovirus E4
  MISC_FEATURE (1)..(420): E4.orf00015 E3 RID-beta
atgcttctactattgctagctcccctggtcgccccctttcccctcaaatcccccacccagtcccccaaagaggttcgaaactgtaaattccaagaaccctggaaattcctcaaatgctaccagctcaaatcagacatgcaccccagctggataattatcatgggaatcgtgaacatccttgcctgcaccttcttttcctttgtgatttacccccgctttgactttggttggaacgcacccgaggcgctctggctcccgcctgatcccgacacaccaccacagcagcagcaaaatcaggcacacgcaccaccaccacagcctaggccccaatacatgcccatcttaaactatgaggccgagccacaacgagccatgcttcctgctattagttacttcaatctaaccggtggagatgactga

SEQ ID NO: 1350 - DNA, 276 bp, Adenovirus E4
  MISC_FEATURE (1)..(276): E4.orf00016 E3 RID-alpha
atgattcctagacagttctttatcattggtcttctctgcgcgctccaagtctgtgccaccctcgctctggtggctaatgcgagtccagactgcattggaccgttcgcctcctacgtgctctttgccttcatcacctgcatctgctgctgtagcatagtctgcctgcttattaccttcttccagttcgttgactgggtctttgtgcgcatcgcctacctgcgccaccacccccagtaccgcgaccaaagagtggcgcagctgctcaggctcatctga

SEQ ID NO: 1351 - DNA, 825 bp, Adenovirus E4
  MISC_FEATURE (1)..(825): E4.orf00018 E3 CR1-delta1
atgaaggcacttagcactttagtttttttgtccttgattggcattgtttttagtaatcctattcctagagttagctttattaaaccagttaatgttactgaagggagcaatgtgacactggtaggtgtagagggtgctaaaaacaccacctggacaaaatatcaccttaatgggtggaaagatatctgcaattggagtgtgacagtttatacatgcgagggagttaatcttaccattgtcaatgcaacctcagctcaaaatggtagaattcaagggcaaagtgttagtgattctgaggggtattatacccaacatacttttatctatgacattaaggtcataccattgccaacacccagcccacctagcactactcaaaccactacatcaactcagcccaccgccaccacaacagcagaggcatttttgttgctgccaccatctagcagtcccactgctagtaccaataagcagactactaaatttttgtccactactgaaagccacaccacagctaccttgagagccttctctagcaccgctaatcttacctcgctttcctatacattaatcagttctgttactacctctaccccagcttctcttcccactcccctgaagcaaaccgaaggcggtttgcaatggcagatcaccctactcattgtgatcggggtggtcatcctagcgatgctgctctacttcatcttctgccgccgcatccccaacgcgaaaccggtctacaagcccatcgttatcgggcagccggagccgcttcaggtggagggaggtctaaggaatcttctcttctcttttacagtatggtga

SEQ ID NO: 1352 - DNA, 663 bp, Adenovirus E4
  MISC_FEATURE (1)..(663): E4.orf00022 E3 CR1-beta1
atggcctctgttacagccattatttattttttgggtcttctgggatttatcaacagttttgaccataaaaacgtaactgcttatgttggttctaactgtgtactaactgggtaccagtcacaccaacgggtttcatggtactggtttgataaaaaaaacacagcttatacactttgcaaaggtaatcagcggcccacacagcgcagtggtctttattacagctgcactaataataatatcacactacttcaagtgactaaacaatattctgggacatactatggaaccaattttaacacggaacaggacacttactatagtgtcaaagtattggatccaactactcccagaactactaccaaacataccacaactaaaaagcccactatacctaaaaccactaaattaacaaccacaaccagcaccacacttgctgtgacctcacaggcaactactgaaaacgaattggttgccctgttgcagaatggggagaataatagcagcagtcctctgcctaccacccccagtgagcaaattcccagatccatgattggcattatcgctgctgtggtggtgtgtatggtcattatcatcttgtgcatgatgtactatgcctgctactacagaaaacacagactgaacaacaagctggacccctactga

SEQ ID NO: 1353 - DNA, 498 bp, Adenovirus E4
  MISC_FEATURE (1)..(498): E4.orf00024 E3 gp19K protein
gtgctggtggcggtactttcgattttgggtctgggcagcgcggctgtagtgacggagaaggccgatccctgcttgacttttaaccccgacaaatgccagctgagttttcagccagatggcaatcggtgcgcggtgttgattaagtgcggatgggaatgccagagcgtggcgatccagtataaaaacaagacgcggaacaatactctcgcgtccacatggcagcccggggaccccgagtggtacaccgtctctgtccctggtgctgacggcttccttcgcacggtaaacaacacttttatttttgagcacatgtgcaataccgccatgttcatgagcaggcagtaccatatgtggcccccacggaaagagaatatcgtggtcttctccatcgcttacagcttgtgcacggtgctaatcaccgcgatcgtgtgcctgagcattcacatgctcatcgctattcgccccagaaataatgctgagaaagagaaacagccataa

SEQ ID NO: 1354 - DNA, 633 bp, Adenovirus E4
  MISC_FEATURE (1)..(633): E4.orf00025 E3 CR1-alpha1
atgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctcgttgaatctaataccacccacaccggaggtgagctccgaggtcctcagtcatctgggatttattacggtccctgggaggtggtggggttaatagctttaggcttagtagcgggtgggcttttggctctttgctacctatacctcccttgcttttcctacttagtggtgctttgttgctggtttaagaaatggggaagatcaccctag

SEQ ID NO: 1355 - DNA, 321 bp, Adenovirus E4
  MISC_FEATURE (1)..(321): E4.orf00026 E3 12.5K protein
atgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctga

SEQ ID NO: 1356 - DNA, 684 bp, Adenovirus E4
  MISC_FEATURE (1)..(684): E4.orf00028 L4 VIII
atgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattga

SEQ ID NO: 1357 - DNA, 141 bp, Adenovirus E4
  MISC_FEATURE (1)..(141): E4.orf00030 L4 22K protein
gtggattttctagctgctggttttgtctttttctgcctcttcttggaagtagtaggggctgtggaggtgacggtagtaatgcaagatgttgcgggggaagttcaccccgcggtgaaagagcaggtagcgccgggtgaatga

SEQ ID NO: 1358 - DNA, 2376 bp, Adenovirus E4
  MISC_FEATURE (1)..(2376): E4.orf00032 L4 100K protein
atggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtag

SEQ ID NO: 1359 - DNA, 1539 bp, Adenovirus E4
  MISC_FEATURE (1)..(1539): E4.orf00034 E2A DBP
atggccggccgcggaggaagtcagttagagcgccgccgggagcgcacccccgatcgcggaaggggctctgccagccacccgccgggccgcgagagcccgtcgcctccgcctctgcccctgaagagacatacctaccgccgcgtggcctcggaccaagaagaagagatagtagtggtgagcgagaactcgcgctccccctcgcctcaggaacaaccaccgccgccgcagcagccgcccaaaaagaaaccccgcaaaacgaagcatgtgcccctgcaggacgtcagccaggacagcgaggacgaaagagaggccgaggaggagctggcggccgtgggcttcagctacccccccgtgcggatcaccgagaaggacggcaagcggagctttgagactctcaatgagaacgacccgctgacgaaggctgctagcgctaagatggcggtgacgaaccccctgagcctgcccattgtatcggcctgggagaagggcatggaaatcatgaatatgctgatggagcgctaccgtgtggaaagcgacctaaaatccaacttccaactgatgcccgagcagggcgaggtgtatcgccgcatctgccacctgtacatcaacgaggagcaccgcggcattccgctgacctttaccagtaacaagaccctgacgaccatgatgggccgcttcctgcaggggttcgtgcatgcgcattcccagatcgcccacaagaactgggagagcacggggtgcgcgctgtggctgcacggctgtaccgaagtcgagggcaagctgcggtgcctgcacgggaccaccatgatccagaaggagcacatgatcgagatggatgtggcaagcgagaacgggcaacgcgcgctaaaggagaaccccgaccgggccaagattacccagaaccgctgggggcgcagcgtggtgcagctggccaacaacgacgcgcgctgctgcgtgcacgacgccgggtgcgctaccaaccagttttctagcaagtcctgcggggtcttcttcaccgagggagccaaggcccagcaggcgtttaagcagctggaggctttcatgaaggccatgtacccggggatgaacgccgaccaggcccagatgatgctgatccccctgcactgcgattgcaaccacaagcccggctgcgtgcccaccatgggccggcagacctgcaagatgacccccttcgggatggccaacgccgaagacctcgacgtggacgggatcaccgacgctacggtgctggcgagcgtgaagcatccggccctgatggtgttccagtgctgcaaccctgtgtaccgcaactctcgcgcgcaaaacgcgggtcccaactgcgatttcaagatctccgcgcccgacctgctgggcgccctgcaactgacgcggaagctgtggaccgactcgttccccgacaccctgctgccgaaactgctgatccccgagttcaagtggctggccaagtaccagttccgcaacgtgtccctgcccgcgggccatgccgaaacctcccggcagaaccccttcgatttttaa

SEQ ID NO: 1360 - DNA, 621 bp, Adenovirus E4
  MISC_FEATURE (1)..(621): E4.orf00035 L3 protease
atggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaa

SEQ ID NO: 1361 - DNA, 2775 bp, Adenovirus E4; identical to SEQ ID NO: 219
  MISC_FEATURE (1)..(2775): E4.orf00037 L3 hexon

SEQ ID NO: 1362 - DNA, 129 bp, Adenovirus E4
  MISC_FEATURE (1)..(129): E4.orf00038 L3 hexon
atgtacgcccactggggcagcatcgatggggtggccatcttgcaactcgacgacgcgcctttctcttcactcctccttctggacagcagcggcggcggacatacacatatacacagacaagcaagttaa

SEQ ID NO: 1363 - DNA, 729 bp, Adenovirus E4
  MISC_FEATURE (1)..(729): E4.orf00039 L3 pVI
atggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagtaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaa

SEQ ID NO: 1364 - DNA, 234 bp, Adenovirus E4
  MISC_FEATURE (1)..(234): E4.orf00040 L2 pX
atggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactga

SEQ ID NO: 1365 - DNA, 1029 bp, Adenovirus E4
  MISC_FEATURE (1)..(1029): E4.orf00041 L2 V
atgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgccgtcgtcgccgcacagctgcaactcccgctgccgccctggtgcggagagtgtaccgccgcggccgcgcgcctctgaccctgccgcgggcgcgctaccacccgagcattaccatttaa

SEQ ID NO: 1366 - DNA, 582 bp, Adenovirus E4
  MISC_FEATURE (1)..(582): E4.orf00043 L2 pVII
atgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttga

SEQ ID NO: 1367 - DNA, 1608 bp, Adenovirus E4
  MISC_FEATURE (1)..(1608): E4.orf00046 L2 III
atgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaa

SEQ ID NO: 1368 - DNA, 1776 bp, Adenovirus E4
  MISC_FEATURE (1)..(1776): E4.orf00047 L1 pIIIa
atgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaa

SEQ ID NO: 1369 - DNA, 1173 bp, Adenovirus E4
  MISC_FEATURE (1)..(1173): E4.orf00049 L1 52K protein
atgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactga

SEQ ID NO: 1370 - DNA, 1875 bp, Adenovirus E4
  MISC_FEATURE (1)..(1875): E4.orf00050 E2B pTP
atgaactacttcctgccgctgcgcaacatctggaaccgcgtccgcgagttccctcgcgcctccaccaccgccgccggcatcacctggatgtcaaggtacatctacggctaccaccgcaccatgctcgaggacctagcgcccggcgcccccgccaccgagcgatggccgctctaccgccagccgccgccgcacttcctcatcggctaccagtacctggtgcgcacctgcaacgactacatcttcgactcgcgcgcctactcgcgcctcaagtaccacgagctcgcgcggcccggtcaccagactgtcaactggtccgtcatggccaactgctcctacaccattaacaccggagcctaccaccgcttcgtcgactttgacgacttccagaccaccctcacccagatccagcaggccatcctcgccgagcgcgtcgtcgctgacctggcgctcgtccagccgcagcgcgggtttgggctcacgcgtatgcacggccgcgcgggcgaggaggaggtgcccgtggagcggctcatgcaggactactacaaggacctggccaggtgtcaggaccacgcctggggcatggccgaccgtctgcgcatccagcaagccgggcccaaagacctggtgctcctcgccaccatccgccgtctcagaaccgcctatttcaacttcatcaccagcagcatcgcccccgcccacaccccaccgccgccagaagaaaccgtgctcagcctaccttgcgactgcgactggctcgaagccttcgttcaacggttttcagatcccgtggatctagagacgcttaggtccttgcgcggagtccctacggggcaattgataagatgcatcgtcagcgcactctccctgcccaacggggaccccccgggccacctggagatgcgcggcggcgtctttacgctgcgaccccgcgaggacgggcgcgccgtcaccgagaccatgcgacgccggcgcggcgagaccatcgagcgtttcatcgaccgtctgcccgtgcgccgccggcgacgcaggccccctcccccgccaccaccgcctgaggaggaagtagaagagatgttagtggatgaagaggaggaagtggaggaactcccgggagccttcgagcgcgaggtgcgcgccaccatcgccgagctcatccgtcttctggaggaggacttgaccgtatctgcacgcaactcccagtttttcaacttcgccgtggacttttacgaggccatggagcgcttggaagccctgggcgacgtcagcgaaatgccgctccgccgctggattatgtacttctttgtcactgagcacattgccaccacgctcaactacctctaccagcgcctctgcaactacgcggtttttgcgcgccacgtggagctcaacctcgcccaggtggtcatgcgcgcccgcgatcccgagggcgccgtggtttacagccgcgtctggaacgaggcgggcatgaacgccttctcgcagctcatgggccgcatctccaacgacctcgcggccaccgtggagcgcgccggccgcggagaccttcaggaggaggagatcgagcagttcatgaccgagattgcctaccaggacaactcgggcgacgtgcaagagattctgcggcaggccgccgtcaatgataccgagattgattctgtcgaactgtctttcaggttcaaactcacgggtcccgtggccttcacccagaggcgtcagatccaggacgtcaaccgtcgcgtcgtcgctcacgccagtcttctccgggcgcagtaccagaacctgcccgcgcgcggcgccgacgtgcccctgccaccactgcctccgggtcccgagccgcccctaccgcccggcgcgcgtcctcgccgccgcttttaa

SEQ ID NO: 1371 - DNA, 3369 bp, Adenovirus E4
  MISC_FEATURE (1)..(3369): E4.orf00051 E2B pol
atggaagccaaaccgcttccgcccgccaagaagaaacgggggacggtggtcactccccaggggcacgggacactgcaagccatcgacgtcgccaccaacggcgcggtggagatcaagtaccatctggacctcccgcgcgcccttgaaaaactcctgcaagtcaaccgcgcgccgccgctgcccactgacctgactccgcagcgtctcaggaccctggacagctccggcctgcgcgccctcgtcctcgctctccgacccgttcgcgccgaggtctggacctgcctcccgcgcgggctcgtcagcatgaccaccatcgaggcagaagagggccaggccgaccaccacgacgtagtacagcaccagatgcaggcgccacgactccacttcccactgaaattcctcgtcaaaggaacccaggtacagctcgtgcagcacgtgcatcccgtgcagcgttgcgagcactgtggccgcttgtataaacacaagcacgaatgttcggcgcgccgtcggcatttctacttccatcacatcaacagccattcctccaactggtggcaggagatccagttcttccccatcggctcgcatcctcgcaccgaaaggctcttcctcacctacgatgtggaaacctacacctggatggggtccttcggcaagcagctcgtccccttcatgctggtcatgaaactctccggggacgaccggctcgttgagctcgcccttgatctcgccctccagctaaaatgggaccgttggcacggcgacccccgcaccttctactgcgtcacccccgaaaaaatggccgtgggtcagcagttccgccagtaccgggatcgtctgcaaaccgccctggccgtggatctctggacttccttcctccgcgccaacccccatctcgccgactgggccctcgagcagcacgggctcagcgaccccgacgagctcacctacgaggagctcaagaaactgccccacgtcaagggccgcccgcggttcgtggaactatacattgtgggccacaacattaacggcttcgacgagatcgtgctcgccgcccaggtcatcaacaaccgggccgaggtgccccagcctttccgcatcactcgcaactttatgccccgcgcgggcaagatcctcttcaacgatgttactttcgctttgcccaaccccgcctacaagaagcgcacggacttccagctctgggagcaggggggctgcgacgatatcgacttcaagcaccagttcctaaaggtcatggtcagggacaccttcgccctcacgcacacctccctgcgcaaggccgcccaggcctatgccctccccgtggagaagggctgctgcgcctacaaggccgttaaccagttctacatgctaggctcttaccgtgccgaccaggacgggttcccccttgaagagtactggaaggaccgcgaagagttccttctcaaccgcgagctgtggaaacaaaagggccagctcaagtatgacatcatccaagagacccttgactactgcgccctggacgtcctcgtcaccgccgagcttgtcgccaagctgcaagactcctacgcccacttcatccgcgactcggtcggcctgccccacgcccacttcaacatcttccaaagacccaccatctcctccaactcccacgccatcttccgtcagatcgtctaccgcgccgaaaaacccagccgcgccaatctcggagccgggctcctcgccccctcgcacgagttgtatgactacgtgcgcgccagcatccgcgggggccgctgctaccccacctacattggcatccttgatgagcccctctacgtctacgacatctgcggcatgtacgcctccgcgctcacccaccccatgccctggggcacgccccttagtccctacgagcgcgcgctggccgtgcgcgaatggcaagcttctctggacgatctgggcacctgcataagctacttcgaccccgacctcctgccaggcatcttcaccatcgatgctgacccccccgacgagcttatgctggaccccctgccccccttctgctcgcgcaagggcggccgcctctgctggaccaacgagcccctgcgcggcgaggtggccaccagcgttgacctcatcaccctgcataaccggggctggcaggtcagaatcgtgccagacgagctaaccaccgtcttccccgaatggaagtgcgtggcgcgcgagtacgtgcagctcaacatcgccgccaaggagcgcgccgacaaggaaaagaaccagaccatgcgctccatcgccaagctcctctccaacgccctctacggctccttcgccaccaaactcgacaacaaaaagattgtcttttctgaccagatggacgaggggctcttgaaaggcatctccgccggcaccgtcaatatcaaatcctcctcgtttctagaaactgacaacctgagtgcggaggtcatgcccgcctttgagagggaatacctaccccaacagctggcgctcctggacagcgatccggaagacagtgaagacgagcagcggcccgcccccttttatacccccccggccgggacccccggtcacgtggcctacacttacaagccaatcaccttcctggatgtggacgagggggacatgtgtttgcatacactggagaaggtggacccgctggtggataacgaccgctatccctcccacgtggcctccttcgtgctggcttggacccgggccttcgtctcagagtggtcgggtttcctctacgacgaggaccgcggcgtcccactcgaggaccgacccataaagtcggtttacggggacacggacagcctctttgtcacccagcggggacacgagctcatggagaccagaggtaagaaacgcatcaaaaagaacggcggaaaactggtttttgatcccaatcagcccgacctcacctggctcgtggagtgcgagaccgtctgcgcccactgcggcgcggacgcctacgcccccgagtccgtcttcctcgcccccaagctctacgccctcaagtccctcctctgtcccgcctgtgggcagacttccaaaggtaagctccgcgccaaaggccacgcggccgaggcgctcaactacgaactcatggtcaattgctacctggccgacgcacagggcgccgatcgggagcggttctcgaccagccggatgagcctgaagcgcaccctcgcaagcgcccagcccggcgcgcacccctttaccgtgacggagaccaccctgacgcggacgctgcgaccctggaaggaccggaccctggccgcgctggacgcccatcgtctggcgccctactcccgcagtcgccccaacccgcgaaacgaggaggtctgctggatcgagatgccgtag

SEQ ID NO: 1372 - DNA, 1047 bp, Adenovirus E4
  MISC_FEATURE (1)..(1047): E4.orf00052 IVa2
atgcccatggccgacgggctcaagccgctgaaaaacttcgcctcgctccaggagctcctctcgctgggcggagagcgactcctggcggaactggtgcgcgagaacatgcacgtgcgccaaatgatgaacgaggtggccccccttcttagggaggacggcagctgtgtctccctcaactaccacctgcagccggtcattggggttatctacggccccaccggctgcggtaagtcccagctactccgcaacctgctttccgcccagctcatctcccccgccccggaaaccgttttctttatcgccccgcaggtggacatgatccccccctcggagcttaaggcctgggagatgcagatctgtgagggaaactacgcccccgggattgagggtaccttcgtcccccaatcgggcaccctccgccccaaattcattaaaatggcctatgaagatctcacccaggaccacaactacgatgtgtccgacccccgaaacgtctttgcccaagccgccgcccacgggcccatagccattatcatggatgagtgcatggaaaacctgggcggccacaagggcgtctccaaattctttcatgccttcccttccaagttgcatgacaaattccccaagtgcaccggatacaccgtgctggtggtcctgcacaacatgaatcccaggcgggatctgggcggtaacatcgccaatctgaagatccaggctaagatgcacctcatctccccccgcatgcatccctcccagctcaacaggtttgtaaacacctacaccaaagggctgcccgtggccatcagtctcctcctcaaagatattgtgcaacaccacgccctgcgtccctgctatgactgggtgatttacaacaccacccccgagcacgaggccctgcaatggagctaccttcacccccgggacgggctcatgcccatgtacctcaatatccaatcccacctctaccgggtcttggaaaagatccaccgggtgctcaatgatcgaggccggtggtccagggcctaccgtgcgcgaaaaatcaaataa

SEQ ID NO: 1373 - DNA, 429 bp, Adenovirus E4
  MISC_FEATURE (1)..(429): E4.orf00054 IX
atgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataa

SEQ ID NO: 1374 - DNA, 1452 bp, Adenovirus E4
  MISC_FEATURE (1)..(1452): E4.orf00055 E1B 55K protein
atggagtcaagaaacccatttcagcagggattaccagctggatttcttagcagtagctttgtggagaacatggaagtgccagcgcctgaatgcaatctccggctacttgccggtacagccgctagacactctgaggatcctgagtctccagcagcaggaggatcaagaagagaatccgagagccggcctggaccctccggcggaggagtagctgacctgtttcctgaactgcaccgggtgctgactaggtcttcgagtggtcgggagaggggtattaagcgggagaggcatgatgagactaatcacagaattgaactgactgtgggtctgatgagccgcaagcgtccagaaacagtgtggtggtatgaggtgcagtcaactggcacagatgaggtgtcagtcatgcatgagagattttccctagaacaagtcaagacttgttggttggagcctgaggatgattgggaggtagccatcaggaattatgccaagctggctctgaggccagatagaaagtacaagattactaagctgataaatatcagaaatgcctgctacatctcagggaatggggctgaagtggagatctgtctccaggatagagtggctttcagatgctgcatgatgaatatgtacccgggagtggtggacatggatggggtcacctttatgaacatgaggttcaggggagatgggtataatgggacggtctttatggccaataccaagctgacagtgcatggatgctccttctttgggtttaataacacctgcatcgaggcttggggtcaggtcggtgttaaggggtgcagtttttcagccaactggatgggggtagtgggcaggaccaagagtatgctgtctgtgaagaaatgcttgtttgagaggtgccacctgggggtgatgagcgagggcgaagccagaatccgccactgtgcctctaccgagacgggctgttttgtgctgtgcaagggcaatgccaagatcaagcataatatgatctgtggagcctcggacgagcgcggctaccagatgctgacctgcgccggtgggaacagtcatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactag

SEQ ID NO: 1375 - DNA, 579 bp, Adenovirus E4
  MISC_FEATURE (1)..(579): E4.orf00058 E1A
atgaggcacctaagagacctgcccgatgaggaaattatcatcgcttccgggagcgagattctggaactggtggtaaatgctatgatgggcgacgaccatccggaaccccccaccccatttgagacaccttcgctgcacgatttgtatgatctggaggtggatgtgcccgaggacgaccccaacgagaaggcggtaaatgatttatttagcgatgccgcgctgctagctgccgaggaggcttcaagccctagctcagacagcgactcttcactgcatacccctagacacgacagaggtgagaaagagatccccgggcttaaatgggaaaagatggacttgcgttgctatgaggaatgcctgcccccaagcgatgatgaggacgagcaggcgattcagaacgcagcgagccatggagtgcaagccgtcagcgagagctttgcactggactgcccgcctttgcccggacacggctgtaagtcttgtgaatttcatcgcatcaatactggagataaagctgtgttatgtgcactttgctatatgagagcgtacaaccattgtgtttacagtaagtgtgattaa

SEQ ID NO: 1376 - DNA, 381 bp, Adenovirus G52
  MISC_FEATURE (1)..(381): G52.orf00001 E4 ORF1 protein
atggctgatcaacatatatatgtgcatttgctgggacgtcgggcctttttgccccagcaacagggttattctaatatgtatgttcttttttcaccggaggattttgtgcttgctcccagagggattattttgctgtctttgcagctgtcgttggatattcccactgggtatctgggacgttttttttctgtggcggatatgaatgtgaggggggtattgctgtgtgctcaggagatccaaccgagtacatggtgggaagtttctgttgttctttttaatcattcggatgaattttaccgcggttcccggggacagccggttgcttgcctgctgctggagcgtgtcatatatcccaccgttcgccaagcttctttagtttaa

SEQ ID NO: 1377 - DNA, 393 bp, Adenovirus G52
  MISC_FEATURE (1)..(393): G52.orf00002 E4 ORF2 protein
atgtatctgagccgccctattttttttgctgtgcatattcccgcacagttgcttcagtacttgcacggactgaatatagaagtactggactttttaaaggagcagcttagtgatttttggctgaacattttacactgtgttactcccattcatcagttttgctactcgggagcggttctagtgagtttggcgccatccctggaacttttgtgctgcgtagccacacctgatttagttcctagcgcggagttaacagatttagtcggcgcagatctatttaattatttgcaaatgaccttgcggatggagattcgcgatcgcggagagcaacctgacctgggtctgttaaatctgctgcaggtgtctcaggagcccgatatcttgcagtcatga

SEQ ID NO: 1378 - DNA, 351 bp, Adenovirus G52
  MISC_FEATURE (1)..(351): G52.orf00003 E4 ORF3 protein
atgatggtgtgtctacgcatggctatagagggcgccctttcggagctttttaatatgcacggcatgaaccttcagactatttgccgcgacatcattcgcgagtggagaaatgaaaattacttgggcattgtacagtcctgcagcttgatgatcgaagagtttgataataacgcttttgctttgctggtgtttgtggaagtgcgggtccaggctcttttggaggccgcgattgatagcctggaaaatcgcataatgtttgatctggctgttaaattccatcagggctccggaggcgaccgttgtcatcttcgggatcttcatttcgacccgttggtgaatcgcttggaataa

SEQ ID NO: 1379 - DNA, 861 bp, Adenovirus G52
  MISC_FEATURE (1)..(861): G52.orf00005 E4 34K protein
atgcaacgcgacagacggtatcgctgcagactggctccctacaatcgtcaccagctaccaccttgtgaggaccgcggcagtgctgttgtagaggagaactctcggtacttagaatgtgaaaatatgaacatgcacaatgttagtgaggtgaggagtataccatcttgtattagctttattgtactgcaggagtggcccgtgtattgggattgtattttaacggcctgggaaaaacatgtgatgaaaatgtatatgaaagtgtgtatctgctgtgccacgttagatctggatttccatcagaccattaggggttatgagagatggattattcactgtcattgtaactctcccggttctcttcagtgtagagctggtggggcggtgttagctaattggtttaagatggctatctatggctccctgataaatgtgaggtttccctggtacaggcaggtggtgaacaggggactgccccgggaggttctgtatgcgggtagcatgtttgtacgcggcagacacctgatttatgttaaagtaaggttggacggacacgcggtggcgctgttggagcgaatgagctttggctggagcgtgttcagctatgggatcatgaacaacctgattgtgatggtgtgcgattcttgccggaatctcagtgagattcagatgcgctgctgcgccagacgcactcgtagactgatgatccatgctgtgaggctgctggacaatctaacttcttaccagcctcacaggagtcgcaccgagaggttcagacagcgccacctgcgtggtttagtggaacatcatcgcacctttaccctgtctgagtttgatcggggagataacccgtggagagcctga

SEQ ID NO: 1380 - DNA, 207 bp, Adenovirus G52
  MISC_FEATURE (1)..(207): G52.orf00006 E4 ORF6/7 protein
atgcagtttttcaccgaaacgttggagaacctgccccagggatttgtgtccatcacggatcgacatctgattaccaaagagactgtttggatcttaactcccaaataccggactggctcgcagcagtttactgccatgaagggagagaggctggtgtatgctgtcaaatggaagggcggaggaagccttactgtgcgtgtaaaataa

SEQ ID NO: 1381 - DNA, 1683 bp, Adenovirus G52; identical to SEQ ID NO: 160
  MISC_FEATURE (1)..(1683): G52.orf00010 L5 fiber protein

SEQ ID NO: 1382 - DNA, 1092 bp, Adenovirus G52
  MISC_FEATURE (1)..(1092): G52.orf00012 L5 fiber
atgaaaagaacccgagttgatgaagacttcaaccccgtctacccttatgacaccacaaccactccagccgttcctttcatatcacccccgtttgtaaacagtgacggtcttcaggaaaacccccccggagttttaagcctgcgaatagctaaacccctgtattttgacatggagagaaaactagccctttcacttggaagagggctaacaattaccgcgaacggacagttagaaagcacccagagcgtgcagactaacccgccgttaactgtcaccaataacaacacacttatcctacgctactcctcccctttaatcctaactgacaataatttaaccgtaggcttctcaagtcctctccgtgttatagacaacaaactgacattcacttttacctcacctctccgttatgaaaacgaaacccttaccttcaattacacagagccccttacacttatgaacagcaaccttgcgcttaacgtaaactcctctaaaggccttagggttgacgggggctcactaggtacaaacctaagtcctgacttaaggtttaacagcagtggagccatagcttttggtatacaaaccctatggacacccccgacctcaaatcctaactgcaccgtttacaccgaaagcgattccttacttagtctctgtttaactaaatgcggagctcacgttttaggaagtgtaagcttaaccggggtagcaggtaccatgacaaacatggctgaaacttcgcttgctattgaatttacgtttgacgacactggaaaactacttcactcaccacttgttaacaacacttttagcattcgtcagggcgacagccccgcctcaaatcctacctacaatgctctagcatttatgccaaacagtaccctctacgctagaggaggaagtggtgaaccccgaaacaattactacgtccaaacatacctcaggggaaatgttcagagaccgattaccctcactgttactttcaactcagccgccacggggtattccttatcttttaagtggactgctgttgtacgtgaaaaatttgcagctcctgcaacttcattttgctacattaccgaacaataa

SEQ ID NO: 1383 - DNA, 162 bp, Adenovirus G52
  MISC_FEATURE (1)..(162): G52.orf00013 U protein
atgaaaattgtgggtgaggacaaggaagtggataccgatatttctttcagggtttggaggaagtttgccgcccaccatcatatcccatatgagagttgggaagagggtaaagtggtgctgctgaatgataataccaaaaaattgctgtcaaatttaaggtaa

SEQ ID NO: 1384 - DNA, 375 bp, Adenovirus G52
  MISC_FEATURE (1)..(375): G52.orf00014 E3 14.7K protein
gtggagatgactgactctcaggacattaatattagtgtggaaagaatagctgctcagcgtcagcgagaaacgcgagtgttggaatacctggaactacagcaacttaaagagtcccactggtgtgagaaaggagtgctgtgccatgttaagcaggcagccctttcttacgatgtcagccttcagggacatgaactgtcttacactttgccttcgcaaaaacaaaccttctgcaccatgatgggctctacctccatcacaatcacccaacaaaccggacctgttgagggagctatcctgtgtcactgtcacgcgcctgattgtatgcccaagctaatcaaaactctctgtgctttaggtgatatatttaaaatgtaa

SEQ ID NO: 1385 - DNA, 273 bp, Adenovirus G52
  MISC_FEATURE (1)..(273): G52.orf00015 E3 RID-alpha
atggtagctgcatttctacttctcctctgtctacccatcattttcgtctcttcaactttcgccgcagtttcccacctggaaccagagtgcctaccgccttttgacgtgtatttgattctcacctttgtttgttgtatatccatttgcagtatagcctgcttttttataacaatctttcaagccgccgactatctttacgtgcgaattgcttactttagacaccatcctgaatacagaaatcaaaacgttgcctccttactttgtttggcatga

SEQ ID NO: 1386 - DNA, 813 bp, Adenovirus G52
  MISC_FEATURE (1)..(813): G52.orf00016 E3 CR1-beta1
atgcttgttatcctcctgctcgccacatttttcgctctctctcacgccagaacaagtattgttggcgcaggttacaatgcaactcttcaatctgcttacatgccagattccgaccagataccccatattacgtggtacttacaaacctccaaacctaattcttcattttatgaaggaaacaaactctgcgatgactccgacaacaggacgcacacatttccccacccttcactacaattcgaatgcgtaaacaaaagcttgaagctttacaacttaaagccttcagattctggcttgtatcatgctgtagttgaaaaaagtaatttagaagtccacagtgattacattgaattgatggttgtggacctgccacctccaaaatgtgaggtttcctcctcttaccttgaagttcaaggcgtggatgcctactgcctcatacacattaactgcagcaactctaaatatccagctagaatttactataatggacaggaaagtaatcttttttattatttaacaacaagcgctggtaacggtaaacagttacctgattattttactgctgttgttgaattttccacctacagagaaacgtatgccaagcggccttacaatttctcatacccgtttaacgacctttgcaatgaaatacaagcgctcgaaactggaactgattttactccaattttcattgctgccattgttgtgagcttaattaccattattgtcagcctagcattttactgcttttgcaagcccaaaaaacctaagtttgaaaaacttaaactaaaacctgtcattcaacaagtgtga

SEQ ID NO: 1387 - DNA, 519 bp, Adenovirus G52
  MISC_FEATURE (1)..(519): G52.orf00018 E3 CR1-alpha1
atgaagatctgtgttgtcatctttgcgctcagtttaataaaaactgaactttttgccgcaccttcaacgccatctgtgatttctacaacaaaaagttcttctggcaaaggtacacaaactgtattttattctaattctacctcatctatcgtgctgaactgcgcctgcactaacgaacttatccagtggattgcaaacggtagtgtgtgcaagtacttttgggggaacgagatagttagtagaaataacagcctttgcgagcactgcaactcctccacactaatcctttatcccccatttgttactggatggtatatgtgcgttggctccggtttaaatcctagttgctttcataagtggtttctacaaaaagagacccttcccaacaattctgtttctttttccaccctgtcctactgctgttctccctctggttactctttcaaacctctaattggtattttagctttgatactgataatctttattaactttataataattaacaccttacagtaa

SEQ ID NO: 1388 - DNA, 318 bp, Adenovirus G52
  MISC_FEATURE (1)..(318): G52.orf00020 E3 12.5k
atgacagatggtgcggccgtgagagctcggctgcgacatctgcatcactgccgtcagcctcgctgctacgctcgggagccgatcgtcttcagctactttgagctgccggacgagcaccctcagggaccggctcacgggttgaaactcgagatcgagaacgcgctcgagtctcgcctcatcgacgccttcgccgcccggcctctcctggtagaaaccgaacgcgggaccactaccatcaccctgttctgcatctgccccacgcccggattacatgaagatctgtgttgtcatctttgcgctcagtttaataaaaactga

SEQ ID NO: 1389 - DNA, 702 bp, Adenovirus G52
  MISC_FEATURE (1)..(702): G52.orf00021 pVIII
atgagcaaggagattcccaccccctacatgtggagttatcagccccagatgggtctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccaaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcacctggacgctacccagacgccttcattcccaactttgacgcagtgagtgaatccgtggacggctacgactga

SEQ ID NO: 1390 - DNA, 357 bp, Adenovirus G52
  MISC_FEATURE (1)..(357): G52.orf00023 33K protein
gtgtggccttccctcgcaacgttctctattattaccgtcatctctacagcccctacgaaacgctcggagaaaaaagctaaggcctcctctgccgcgaggaaaaactccgccgccgctgccgccaaggatccaccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaa

SEQ ID NO: 1391 - DNA, 135 bp, Adenovirus G52
  MISC_FEATURE (1)..(135): G52.orf00024 22K protein
atgacggtaataatagagaacgttgcgagggaaggccacaccgtgatggaagaggaggtagcgtcgggcaaaggagatgtttcccccgcagtgttgcaagcagttcacgatactgcttttgtgggcccgccatga

SEQ ID NO: 1392 - DNA, 2295 bp, Adenovirus G52
  MISC_FEATURE (1)..(2295): G52.orf00026 100K protein
atggagcttatgcgcgaggaaactttaaccgccccgtcccccgtcagcgacgaagatgtcatcgtcgaacaggacccgggctacgttacgccgcccgaggatctggaggggcctgaccggcgcgacgctagtgagcggcaggaaaatgagaaagagaaggcacagggctgctaccttctggacggcgacgttttgctaaagcatttcgccaggcagagcaccatagtcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtattcgccgtgcccgaggcgctggccacctatcacatctttttcaaaaaccagcgcatccccctctcgtgccgggccaaccgcaccgcggccgataggaagctcaggcttaaaaacggagccgacatacctgatatcacgtcgctggaggaagtgcccaagattttcgagggtctgggtcgagatgaaaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggagtccctgcactacaccttccgccagggctacgtccgccaggcctgcaagatctccaacgtggagctcagcaacctggtctcctacatgggcatcctccacgagaaccgactggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggattttgcccgccatgagctgcgcgctaccctctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctgctcagcgaaacccaggtcataggtaccttcgagatccagggaccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacttagacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagctgtgggacagccaggcagaggaggtgtcagaggacgaggaggagatggaaagctgggacagcctaggcgaggaggaggacgagctttcagaggaagaggcgaccgaagaaaaaccacctgcatccagcgcgccttctctgagccgacagccgaagccccggcccccgacgcccccggccggctcactcaaagccagccgtag

SEQ ID NO: 1393 - DNA, 1389 bp, Adenovirus G52
  MISC_FEATURE (1)..(1389): G52.orf00030 DNA binding protein
atggccaaccgtcagaaccaagcaggcagctccataaccccctacttgcgggagatgagccccgagcgcgagcaggaggtgcctccgctccctcccaagaagaaggctcgcaaggcaacacttgcgccgccgccatccccggagattgtctccgacagcgagggcgaaggcaccgtggtggaggtgggcttcagctaccctccgatgcgcagagtacgccgcgcggacggcaccgtggagtttcaaagaatgaccatgaaggacgtcggggccggcgagggcccctccaccgccgtgttggtgaagaaccccgagagcgcgccgctggtgactgcctgggagaagggcatggaagtcatgacggtgttgatggagaagttccacgtggacaacgagagcagaggggcttttaagtttctgcccgaccagggagccgtgtaccgcaagatctgtcaaacttggttgaacgaggagcaccgcggcctgccgctgaccttcaccaaccagaagaccttcaccgagctgatgggcagattcctcatggcttacatggaagcatacgcgggggtgaaacgcaagagctgggagcccaccgggtgcgccgtgtgggagcatcgcaatacccggcaggagggcgtcctgttctgcttccacggagtggagatggtctgcaaggagcacgtggtggaaatggatgtgaccagcgagaacggtcagcgggcgttgaaggagcatcctacgaaagccaaggtggtccagaaccgctggggtcgcaacgtggttcagctgaagaatgaagacgcccgctgctgctcggaagacatcaactgcggcaataacgtattctctagcaagtcctgtgggctctttttcaccgagggcacgaaggcccagatggccttccgtcagatggaggagttcctggcagcgagttaccctatcatgcaacgcgggcagcgtcgcatcctgatccctctgcgctgcgattgcctcaacaaacccgacctggtgccccagatcgggcggcagatgtgcaagctgaccccgttcgccctgagcaacgccgaggatctggatgcgtcggaggtgaccgacccaacggccctggctagtattcacaaccccagcgtgatggtgttccagtgtgccaaccccgtgttccgcaacagccgcgggagctccggccctaactgcgacttcaagatatcggcgcccgacgtcatgggagccctgcagctggtgcggcagttttggaagcagaacctagaagacgtgcccctgccgcggctggtgatccccgagtttcgttggagcgcccgtttccagtatcgcaacgtgtccctccccagtgggcacgaggacccctccctcgaacccttcgatttttaa

SEQ ID NO: 1394 - DNA, 501 bp, Adenovirus G52
  MISC_FEATURE (1)..(501): G52.orf00032 L3 protease
gtgccatcgttaacacggccggacgggaaaccggggggggtccactggctcgccttcgcctggaacccgcgtaaccgcacctgctacctgttcgacccttttggtttctccgacgaaaggctgaagcagatctaccagttcgagtacgaggggctcctcaagcgcagcgctctggcctccacgcccgaccactgcgtcaccctggaaaagtccacccagacggtccaggggcccttctcggccgcctgcgggctattctgttgcatgtttttgcacgccttcgtgcactggcctcacacccccatggatcacaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgaacgggccacggccttcgaaagcatgagccaaagagtgtaa

SEQ ID NO: 1395 - DNA, 2763 bp, Adenovirus G52; identical to SEQ ID NO: 220
  MISC_FEATURE (1)..(2763): G52.orf00034 L3 hexon

SEQ ID NO: 1396 - DNA, 834 bp, Adenovirus G52
  MISC_FEATURE (1)..(834): G52.orf00035 pVI
atggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggacaccaactttcaagaaaaagtggtcaacggggtggtgaccggcatccacggcgcggtagatctcgccaatcaagcggtgcagaaagagattgataggcgtttggaaaattcgcgggtaccgccgcagaggggggatgaggtggaggtcgaggaagtagaagtagaggaaaagctgcccccgctggagaaagttcccggtgcgcctccaagaccgcagaagcggcccaggccagaactagaagaaactctggtgacggagagcaaggagcctccctcgtacgagcaagccttgaaagagggcgcctctccaccctcctacccgatgactaagccgatcgcacccatggctcgaccggtgtacggcaaggattacaagcccgtcacgctagagctgcccccaccgcccccttcgcgtccgacagtgcctccactgcctgccccgtcggcgggtcccgtgtctgcaccatccgctgtgcctctgccagccgcccgtcccgtggccgtggccactgccaggaaccccagaggccagagaggagccaactggcaaaacacgctgaacagcatcgtgggcctgggggtgaaaagcctgaaacgccgccgttgctattattaa

SEQ ID NO: 1397 - DNA, 213 bp, Adenovirus G52
  MISC_FEATURE (1)..(213): G52.orf00036 pX
atggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgccgccatcggtgccatacccggcgtcgcttcagtggccttgcaagcagctcgtaataaataa

SEQ ID NO: 1398 - DNA, 1038 bp, Adenovirus G52
  MISC_FEATURE (1)..(1038): G52.orf00037 V
atgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcagtggaaagggcgacgggtacaacgcgttttgaggccgggcaccgcggtagtttttaccccgggagaacggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggacagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgtcacgtcagcttcaaccgccgtggaagccatggaaacgcaaaccgaaacccccgccgcggttggtaccaaagaagtggcgttgcaaaccgacccctggtacgaatttgccgccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaa

SEQ ID NO: 1399 - DNA, 564 bp, Adenovirus G52
  MISC_FEATURE (1)..(564): G52.orf00038 pVII
atgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctctggccgaacggctgtagacgataccatagatgccgtgattgccgacgcccgccggtacaaccccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttag

SEQ ID NO: 1400 - DNA, 1512 bp, Adenovirus G52
  MISC_FEATURE (1)..(1512): G52.orf00039 III
atgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcgcccctgtacgataccaccaaggtgtacctggtggacaacaagtcggcggacatcgcctccctgaattaccaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggctaaaaaccagcctcccgagtacgaatggtttgagttcaccattcccgagggcaactattccgagaccatgactatcgatctgatgaacaatgcgatcgtggacaattacctgcaagtggggaggcagaacggggtgctggagagcgatatcggcgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttagggatcagaaagcgccgccccttccaagagggctttcagatcatgtatgaggacctggaaggaggtaacattccaggtttgctagacgtgccggcgtatgaagagagtgttaaacaggcggaggcgcagggacgagagattcgaggcgacacctttgccacggaacctcacgaactggtaataaaacctctggaacaagacagtaaaaaacggagttacaacattatatccggcactatgaataccttgtaccggagctggtttctggcttacaactacggcgatcccgagaagggagtgagatcatggaccatactcaccaccactgacgtgacctgcggctcgcagcaagtgtactggtccctgccggatatgatgcaagacccggtcaccttccgcccctccacccaggtcagcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaa

SEQ ID NO: 1401 - DNA, 1710 bp, Adenovirus G52
  MISC_FEATURE (1)..(1710): G52.orf00040 pIIIa
atgcagcggccggcggacggggccaccgcggatcccgcaattttggcatccctgcaaagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtaccgtcgcgcaccaacccgacgcacgagaaagtcctgactatcgtaaacgccctggtagacagcaaagctatccgccgcgacgaggcggggctgatctacaacgctctgttggaacgggtggcgcgctacaacagcactaacgttcagaccaatctggatcgcctcaccaccgacgtgaaggaggcgctggctcagaaggagcggtttctgagggacagcaatctgggatctctggtggcactcaacgccttcctgagcacgcagccggccaacgtgccccgcgggcaggaggactacgtgagcttcatcagcgctctgaggctgctggtgtccgaggtgccacagagcgaggtgtaccagtctgggccggattacttcttccagacgtcccgacagggcttgcaaacggtgaacctgactcaggcctttaaaaatttgcaaggcatgtggggcgtcaaggccccggtgggcgatcgcgccactatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagccgggccctgggtcaggaagatatcggcagcctggaagccacgttgaactttttgctaaccaaccggaggcaaaaaataccctcccagttcacgttaagcgccgaggaggagaggattctgcgatacgtgcagcagtccgtgagtctgtacttgatgcgggagggcgccaccgcttccacggctttagacatgacggctcggaacatggaaccgtccttttactccgcccaccgaccgttcattaaccgtttgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgatagcattttcacgccggctaatcgccgattccagaagaaggagggcggagacgagctccccctctccagcgtggaagctgcctctaggggagagagcccctttcccagtctgtcttccgccagcagtggtcgtgtcacgcgcccacggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgccagagagaagacccggacgactccgcagacgatagtagcgtgttggacctgggagggagcggagccaacccctttgctcacttgcaacccaaagggcgttcgagtcgcctgtactaa

SEQ ID NO: 1402 - DNA, 1128 bp, Adenovirus G52
  MISC_FEATURE (1)..(1128): G52.orf00042 52 kDa protein
atgcatccggtgctgcggcagatgcgaccccagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgggagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgaaacgttccgcgacgccatgttgaacatcgcggagcccgagggtcgctggctcttggatctgattaacatcctgcagagcatcgtggtgcaggagaggggcctgagtttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctga

SEQ ID NO: 1403 - DNA, 1896 bp, Adenovirus G52
  MISC_FEATURE (1)..(1896): G52.orf00045 DNA terminal protein
gtgcccaccatggaacgctttcgccccctgcgcaacatctggaaccgcgttcgcgaattcaccagggccgcgaccacctcggccggcatcacctggctctcccgctacatctaccactaccatcgcctcatgctggacgacctgtcccccggcgcccccgccaccgtcggctggcccctgtaccgagagccgcctcctcacttcctggtcggctaccagtatctggtgcgcacatgcaacgactacgtgttcgagtccagggcctactcgcgcctcaagtacacggagatcacccaacccggcatgcaagtcgtgaactggtccgtcatggccaactgcacctacaccatcaacacgggggcctatcaccgcttcgtggacctggacgacttccagaccaccctcacgcagattcaacaggccgtgctggccgagagggtcgtggccgacctagcgttgctgcagcccctgcgggggttcggctcgactcgcatggcagacaggggagaagcagaggttccggtggagagactgatgcaagactactacaaagacctgcgtcgctgtcagagcgaggcctggggcatggccgagcgcctgcgcattcaacaggccgggcccaaagacgtggtcctcctcgccaccatccgccgcctgaagaccgcctactttaattacatcatcagcagcatcacctcccaactgcccgcggacgccccccagcggcccaccgtcctcagcttaccttgcgattgcgattggatagacgctttcctagagaagttctcggatcccgtcgacctcgacgttctcagatccctgcacggagtgcctacgcagcaattgataaaatgcatcgtcagcgccgtgtccctgcccgacggccctaaccacttaccctccctgcacgggggcgctctgcgcggcggcgttttcgaactgcgacctcgcgaaaacggacgcgccgtcaccgagaccatgcgtcgccggcgcggcgaaatgatcgagcgcttcgtggaccgcctgccggtcagacgacgacgtcgccgccccgtccccgtcgcagagctggcggaggaacctgtgcccctggaagaggaggagccggaggaagaagcagaggcgcctcggggcgctttcgaacaggaggtacgcgacacggtcgccgatctcatccgcctcctgcaagaagaactcacggtagccgcccgcaactcccaatttttcaacttcgccgtcgacttctacgaggccatggagcgtctcgaagccatcggagacatcaacgagatgaccctgcgacgctggatcatgtacttcttcgtctgcgagcacatcgccaccacgctcaactacctctttcagcgcctcagaaactacgccgtcttcgcccgtcacgtggaactcaacgtggcccaggtggtcatgcgagcgcgcgactccttcggcaacgtggtgtacagccgcgtgtggaacgagaacggcctcaacgccttctctcaactcatgcgtcgcatctccaacgacctggccgccaccgtggagcgagcgggtcacggcgacctccgcgaggaagaagtggagcagttcatggccgagatcgcctatcaagacaactcgggcgacgtacaggagatcctcaggcaggccgccgttaacgatgcagacattgattctgtggaactctctttcaggttcaggacccggggaccggtggtcttcacgcagagacagcacatccaggacctcaaccgccgcgtcgtcgcccacgccagcagtctccgggctcgtcatcaaccgctgccgaatcctcacgaaaacgtgcctctgcctccatcgccccccggcgcagagccgcctctgccccccggcgctcgccctcgacgagtgagataa

SEQ ID NO: 1404 - DNA, 3327 bp, Adenovirus G52
  MISC_FEATURE (1)..(3327): G52.orf00048 DNA polymerase
gtggtagccccgcgcggacacggcctcctctacgccgtggacgcctcttccaacacccccctggaaatcaagtaccatttgcacctggctcacgctcttaccggtcttctgaaagtgaacttgcaaacgcttcccgtcgacctcagcgcggccgccctcgactccctggacagcgggcagctgcgccccctcctgcagcgcctgcgcccctccgtggcggagatctggacttgcggcacacggggcgtcgtcgtccccaccgtcgtccacccagagaagaagggcgcagacgcagactcccaccgccaaggcgaaggggatgccgccccaccaagcccccgtctcaacttccccctccggtttctggtgcgcgggcgaaaagcgcatctcattcaggagatacagagcgtgcagcgctgcgactactgcggtcgcttttacaaacatcagcacgaatgctctgtgcgccggcgggacttctactttcaccacatcaacacccattcctccaactggtggcaggagatcagcttcttcccgatcggctcccacgcgcgcacccagcggctctttgtcacctacgacgtagaaacctacacatggatgggctcgttcgggaaacagttggtacccttcatgctggtcatgcacgtctcgggcgaggagaccctcgttcgccaagcctgcgagctggccctagagctccgatgggacgtctggaacgaccgcccctgcactttctacgtggtgacgccggagaaaatggccgtggggaaaaagtttcgcgagtttcgcgaccgcttgcaaactctgctagcccttgacctatggagctctttcctcgcggctaaccctcagctctccgactgggcccgggcggagctgggtctctcctcgccggactgtctcacctacgaggagttgaaaaaagcgccggccctcaagggacagccgcgctttatcgaactttacatcgtgggccacaacatcaacggcttcgacgagatcgtcctggcggcgcaagtcatcaacaaccgctcggacgtacccggacccttcaggatctctcgcaacttcatgccccgtgccgggaaaatcctctttaacgacgtcaccttcgccctccccaatcccaggcagaaaaagcgcaccgacttcacgctgtgggaacagggtgcctgcgacgacacggacttcaaacatcagtacctgaaagtgatggtgcgggacaccttcgccctcacccacacctctctcagaaaggccgctcaagcgtacgccctgccggtagaaaaaggctgttgtccatacaaagccgtgaacgaattttacatgttaggttcttaccgagcggacgaaaaaggatttcccgccgaagagtactggaaagaccgcgaggaatacctcctcaatcgcgaactgtgggagaaaaaacaagagacggcctacaacctggtccgcgagacgttggactactgcgctctcgacgtgctggtaaccgcagccctggtggacaagctccgggaatcctacgcccagttcatccaagactccgtgggactgcccggggccaactttaacgtcttccaacgccccaccatctcttccaactcccacgccatcttcaggcagatcctctaccgggccgaaaaaccccgcaagacccacttgggagacgggctcatggctccctctcacgagatgtacgactacgtgcgagccagcatccgcggggggcgctgttaccccacttacatcggggtgttgagggagcccctgtacgtgtacgacatctgcggcatgtacgcctcggccctgacccaccccatgccctggggaccgcccctgaatccctacgaaagggccctcgcggtgaagaagtgggacgaggcgttgcaagacacggacacacaaatcgattattttaatcaggttttgctacccggcatcttcaccatcgacgccgaccccccgcccgccaacttgctagatcccctgcctccgttctgctccagaaaaggggggcgattgtgttggaccaacgagcccctccgcggggaggtggccaccagcgtggacctcatcaccctgcacaaccgcggctggcgcgtgcgcatcctgcccgacgagcgcaccgccgtgttccccgagtggcggtgcgtggcccgcgagtacgtgcaactgaacatcgccgccaaggagagggccgatcgggagaaaaatcagaccctgcgctccatcgccaagttgctttccaacgccctctacgggtctttcgccaccaaacttgacaataaaaagatcgtgttttctgatcagatggacccttccaccatcaaaagcatcgccgcggggcacgtgaatatcaaatcctcctctttcgtagaaactgacaacttgagcgccgagatcatgccggcttttgagagggcctactcacccgaacagctggctctggtccacagcgatgcggaagaaagtgacggggagggtgggcacgcccccttttatacccctttggggggtgcgggtcacgtgacctacacttacaagccaatcaccttcgtggacgcggaggaggacgacctgtgtctgcacaccctggaaaaggtggaccccctcattgaaaacgacagatacccctcgcagatcgcctccttcgtgttagcctggacccgagcctttgtctcggagtggtcccagttcctgtacgcggaagatctcggaacacctttggaagatcgccccctcaagtcggtctacggggacaccgacagcctttttgtcacggaagctggacacagactcatggagacgcaaggtaagaaacgcatcaaaaaaaatggaggcaacttggtttttgatcccgctaaacccgagctcacgtggctggtggagtgcgagaccgtctgcgctcagtgcggagccgacgcctactcgcccgagtcggtcttcctggcccccaaactctacgccctcaagtgtctgcactgcaccaaatgtcagcacgtttccaagggaaagctgcgcgccaagggacacgcggccgagtccctcagctacgacctcatgcttcgttgctatctggccgactcacagggagacgacgcccgcttcagcaccagcaggatgagcctgaagcgcaccctcgcaagcgcccagcccggggctcatcccttcaccgtcaccgagaccaccctcacccgaacactgagaccctggaaggacagaaccctcgcggccctggacgcccaccggctggtgccctacagcgaaagtcggcccaacccccgcaaccaagaagtctgctggatcgagattccatag

SEQ ID NO: 1405 - DNA, 1047 bp, Adenovirus G52
  MISC_FEATURE (1)..(1047): G52.orf00050 IVa2
atgcccatggcagacggcctgaaaccgctgaaacacttcaacagcctggaagaactcttatccctgggtggggagaggctcttgcaaaacttagtgagtgaaaataaacatgtcagaagcatgatgaacgatgtagcccccctcctgcgccccgacggcagctgttcctctctcaactaccagctgcaacccgtcatcggggtcatctacggtcccaccggctgcggcaaatcccaactgttgcgtaacttgctttccacccagctcatcaatcccccgccagaaaccgtgttctttatcgccccccaggtggacatgatacccccctcggaaattaaggcctgggaaatgcagatttgtgagggcaactacgccccaggcccagatggaactatcatcccccagtcgggcaccctcctaccccgctttgttaagatggcctatgatgagctcactctagagcaaaactatgatgtttccaacccccaaaacgtgtttgccaaagcggccgccaggggtcccattgccatcattatggatgagtgcatggaaaacctaggaggccacaagggggtctctaaattcttccacgccttcccctccaaactgcatgacaagttccccaagtgcaccggctacaccgtgctggtggtccttcataacatgaacccccgcagggacctaggtggtaacatagctaacctcaaaattcaagccaagatgcatatcatctccccccgcatgcatccctcccagcttaaccgctttgttaacacctacactaaggggctgcccttggccatcagcctgctcctaaaggacatcttccagttccacgctcagaaaccctgctacgactgggttatttacaacaccaccccggagcatgacgctctgcaatggtcctatctccacccccgggatggcctcatgcccatgtacttgaacatccaagcccatctgtaccgggtcttggaaaacatacacaaggtccttaacgaccgggacaggtggacccgagcctaccgagccaaaaaaaacaaataa

SEQ ID NO: 1406 - DNA, 408 bp, Adenovirus G52
  MISC_FEATURE (1)..(408): G52.orf00051 IX
atgagcgggacgacggacggcaacgcgtttgaggggggagtgttcagtccatatctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaactccgattctacagaatcttaa

SEQ ID NO: 1407 - DNA, 1113 bp, Adenovirus G52
  MISC_FEATURE (1)..(1113): G52.orf00052 E1B 55K protein
atgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttacactattcgccgcactgttaatataaaaaagagtgtttatgttattggtcatggagctctggtgcaggtgcagaccccagaccgggtggctttcaattgcggcatgcagagtttgggccccggggtgataggtttgaatggagttacatttcaaaatgtcagatttactggtgataattttaatggctctgtgtttgtgactagcacccagctaaccctccacggtgtttacttttttaactttaacaatacatgtgtggagtcatggggtagggtgtctctgaggggctgcagttttcatggttgctggaaggcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaattgtcacaccttgcgcaccgtgcacatagtgtcccactcgcgccgcacctggccaacatttgagcacaatatgctcatgcgttgtgccgttcacctaggtgctagacgcggcgtgtttatgccttaccaatgtaactttagccatactaagattttgctggaaactgattccttccctcgagtatgttttaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtga

SEQ ID NO: 1408 - DNA, 534 bp, Adenovirus G52
  MISC_FEATURE (1)..(534): G52.orf00053 E1B 19K protein
atgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagggtaaaaagagagcaggaggcgcagtttgctaggctgttggccgatactcctggagtttttgtggctctggatctaggccatcactctcttttccaagagaaaatcatcaaaaacttaacttttacgtctcctggtcgcacggttgcttccgctgcctttattacctatattttggatcaatggagcaacagcgacagccacctgtcgtgggagtacatgctggattacatggcgatggctctgtggagggccatgctgcggaggagggtttgcatttacttgcgggcgcagcctccgcggctggaccgagtggtggaggagaacgagccggaggagaccgagaatctgagagccggcctggaccctccagtggaagactag

SEQ ID NO: 1409 - DNA, 207 bp, Adenovirus G52
  MISC_FEATURE (1)..(207): G52.orf00054 E1A protein
gtgtctgacgcggaaggggacggagatagatcagggtctgctaattctccttgcactttgggggctgtggttccagttggcattattaaacccgtggcggtcagagtctcaggcagacggtgtgcagttgaaaaattggaagacttgctacaggaagaacagacggaacctttggacctatccatgaaacgccctaagctgacctaa

SEQ ID NO: 1410 - DNA, 360 bp, Adenovirus G52
  MISC_FEATURE (1)..(360): G52.orf00057 E1A protein
gtggaagtggatccaccgcaagatcccaacgaggacgcggtaaacagtatgttccctgaatgtctgtttgaggcggctgaggagggttctcacagcagtgaagagagcaaacggggagaggaactggacttgaaatgctacgaggaatgtctgccttctagcgattctgaaacggaacaaacagggggagacggctgtactgagccggtagtgaaaaatgaacttgtattagactgtcctgatcaacctggtcatggctgccgtgcctgtgcttttcatagaaatgccagcggaaatcctgaaactctatgtgctctgtgttacctgcgtcttaccagcgattttgtatacagtaagtag

SEQ ID NO: 1411 - DNA, 34188 bp, Adenovirus F41
catcatcaataatataccttaaagctggaaacgagccaatatgataatgagtgaggaggggctaggggtggtgcgaagtgacgtataggtaggcggggtgggaaagggtggaggtgaatgacgttggggtcgaaggttggggagtggcgcggcggaagtgacggatccggtagtatgttttgaccggaaatttggtgtattgggcgggtttttgtaactttttggttattttggcgcgaaaactgagtaatgcggaagttgaacgaactctggactttttatggctagggagggaaaactgctgatcattgctgaactttggggctttgacgtggcggtttccctacgtggcactgccacgcgaatgctcaaagtccttattttattgtgtgttcagcccttttgagggtatttaaacacagccagaacgtcaagaggccactcttgagtgccagcgagtagagttttctcctccgttgccgccgagatgagaatgctgccggacttcttcaccgggaactgggatgacatgttccaggggctgctggaggctgagcatctgtttgattttcctgaaccttctcaggcttttgaagagatttcgcttcacaatctttttgatgtggagctggatgagtctgaaggggatccgaatgaggaagcggtagatggtatgtttcctaactggatgctgtccgaggaccacagtgctgacagtggtgcggcttcgggcgattctggggttggagaagacctggtggaggttaatttggacttgaaatgctatgaagagggtttgcctcctagcggctcggaggctgatgaagctgaagaacgagcggaggaggaagagacggctgtgtcgaattatgtgaatattgctgagggtgctagtcagctggtgttggactgtccagaaaacccgggacgaggttgtcgggcttgtgattttcatcggggctctagtggaaatcctgaagctatgtgtgctttatgttacatgcgtctgaccggtcactgcatttacagtaagtagagatttttttttttgttttatactgctggatgatgtgtgggggttaacgtgcttttttgtgcttactaggtccgatttcagatgcggaaggagagtgtgagttggggtcaaatgaggagactgagctgccttgttctttgaccgccacggcaccagtaagacccaccccatgcagagtttcctgtagacgacgcccagccgttgattgcatagaagatttacttgaggaggatccgacggatgaacctttaaacttgtccttaaagcgccccaagtcctcttgagattatgtagtaataaaattattgatgtttagcctgtgttttatttcttgggtgtgtccgcgggtatataagcaggtggagtggtttcagtgttagtttattctgatggagttttggagtgagctacaaagttatcagagcctccgacgcttgctggagttggcttctgccagaacttccagctgttggaggtttatttttggttcaaccttaactaatgtaatttatagagctaaagaggactactcttcgcgatttgctgagcttttgtcttttaaccctggaatttttgcatctttaaatttgggccaccactcatttttccaggaaattgtgatcaaaaacttagatttttcttcccccggccgtacggtttctgggcttgctttcatttgttttatattggatcaatggagcgcccaaacccatctgtcggaggggtatactctggattacatgacaatggccctgtggagaaccctgctgcggaggaagagggtcttaggttgctcgccggcgcagcctccgcacggtctggatccagtgcgggaggaggaggaggaggaggaggaggaggagaacctgagggccggtctggatcctcaaacggaattgtaactgaacctgaccccgaagagggtactagcagtgggcaaaggggggagaaaaggaagttagaaaatgacggggcggattttctaaaggagttaaccttgagtttaatgtctcgttgttatcctgagtctgtctggtgggctgatttggaagatgagtttaaaaatggaaacatgaatcttttatacaagtatggatttgaacagctgaaaacacattggatggagccttgggaggactgggaactagctttgaatatgtttgccaaagtggctcttcgcccagacactatttataccattaagaaaactgttaatatacgtaaatgtgcctatgtaattggaaatggagccgtggttagattccaaacctttgaccgggtggtttttaactgtgcaatgcagagtttaggtcctggggtgattggtatgagcggggtaacatttaataatgtcagatttgcagcagatggatttaatggcaaggtgtttgcttctaccactcaattaactttgcatggtgtgttttttcaaaattgcagcggtgtttgcgtggattcctggggtagggtgtctgccagaggttgtacgtttgtgggatgttggaaagggctggtggggcaaaacaagagccaaatgtctgtaaaaaaatgtgtgtttgaacgatgcattttggctatggtggtagaaggccaggcgcgaattcgacataatgcgggttccgaaaatgtgtgctttttactgctgaagggaactgccagtgttaagcataatatgatttgtggcactggtcactctcagctgctaacttgcgcagatggaaactgtcagactctaaaagtgattcatgtggtttcccatcagcgccgcccctggcctgtttttgagcataacatgcttatgcgttgtaccatgcatttgggggctcgtcgtggcatgttttctccatatcagagtaatttttgccatactaaagttttaatggaaactgatgctttttcgcgggtgtggtggagcggggtgtttgatttgaccatagagctgtataaagtggtgagatatgatgagttaaaggctcgttgtcgcccctgtgagtgtggagccaatcacatcaggttatatccagcaactctgaacgtgacggagcagctgcgcacggaccatcagatgttgtcgtgtcttcgcaccgactacgaatccagcgatgaggattaagggtaaggggcggagcttattacaggtataaagtctgggggtggaggaaggaaaggaagttttaaaatgagcggctccatggaagggaacgctgtgagttttaagggtggggtgtttagcccatatttgacaacccgtcttcccgcttgggcaggagtacgtcagaatgtgatgggctccaacgtggacggtcgtcctgtcgcccccgccaattcagcaacccttacctatgccactgttggatcgtcggtggacaccgctgcggctgctgccgcttctgccgctgcctctactgctcgtggtatggcagctgattttggactttacaatcaactggctgcgtctcggtcgttgagggaagaagatgccctgtctgtggtgctgacccgcctggaggagctgtctcagcaattgcaagatttgtttgccaaagtggccctgcttaaccctcccgctaatgcttcttaaataaataaaagacacaactgtttgaaaagtcaagagtgtttatttgtttcttttgcggtaggccctggaccacctgtcgcggtcgttgaggactttgtggatgttttccaagacccggtacaaatgggcttggatgtttagatacatgggcataaggccgtccctggggtggaggtaggaccactggagggcgtcatgctcgggggtggtgttgtaaataatccaatcgtaacagggtttttgggcatgaaactgaaatatgtccttaaggagcaggctaatggccaggggtagtcccttggtaaaagtattaacaaatcgattaagttgggaaggatgcatgcggggggagattagatgcatttttgcctggatttttagattggcaatgttacccccgaggtcccgtctggggttcatgttgtgcaggaccaccagcacggtgtagccggtgcatttggggaatttgtcatgcaacttggaagggaaggcgtggaaaaactttgaaacccctttgtgaccccccagattttccatgcactcatccataattatggcgatgggacctttggccgcagctttagcaaaaatgttattggggtgggatacatcatagttttgctccaacgtgagctcgtcataggccattttaacaaagcggggaagaagggttcctgactgggggattatggtaccttccggaccgggggcatagttaccctcgcaaatttgcatctcccaagccttaatttcggatgggggaatcatgtccacttggggggcgatgaaaaaaacggtttcggggggaggattaataagctgggaggaaagcaggttccgcagaagctgggatttgccgcagccagtggggccataaatgaccccgatgacaggctgcaattggtagtttaaggagctgcagctgccgtcttcccgcaggagtggggtaacttcgttcatcatgcttctgacatgctggttttccctgaccaggtcttgcaagagacgttcaccacccagggaaagaagctcttccaagttgcggaaatgctttagtggttttaggccgtcggccatggtcattttttccaaagactgacgtagaagatagagccgatcccagagctcggtgatatgctctatggcatctcgatccagcaaacttcttggttgcggggattgggccggctttggctgtacggtaccagccggtgggcgtccagaggggcgagggtgatgtctttccaaggccgaagagttcgcgttagggtggtctcggtgacagtgaagggatgcgctccgggctgggcgcttgccagggttctcttcaggctcatcctgctggtgtgaaagcgcgcgtcttcgccctgagagtcagccaagtagcattttagcatcagctcatagcttagggcttcggctgcgtgtcctttggctcgaagcttgcctttggaaatgtgctgacagctgggacagtagaggcatttcagggcgtagagtttgggtgccaggaagacagattccggcgagtaagcgttggcaccgcactgtgcacacgtggtttcgcactccactaaccaggttagttcgggattttttggatcaaaaaccagactgcccccgtgttttttgatgcgtttcttacctcgggtttccatgaggcgatgaccggcttcggtgacaaagaggctgtcggtgtcgccgtataccgatttgagggtacgctgctccaacggcgtgcctcggtcctccgcgtacagaaactcggaccattctgagacaaaagcccgggtccaggccagaacaaaggaggcaatttgggaggggtagcggtcgttttccaccagggggtcaaccttttctagggtgtgaaggcaaaggtcatcttcctctgcatccataaatgtgattggtttataagtataggtcacgtgacctttggggtcttgcgtgggtgtataaagggcgtgtccgcgttcttcatcactttcttccgcatcgctgtgggcaagagccagctgttcgggtgagtacgcgcgctggaaggcgggcataacttcagcactcaaggtgtcagtttctacgaacgaggtggatttgattttaatttgtcccgcggcaatgcttttgatggtggcagggtccatctggtcagaaaacacaatttttttattatctagtttggtagcaaacgacccgtaaagggcgttggaaagcagcttggcaatggaacgcagcgtctggtttttctcgcgatcggcccgctccttggcggcgatgttgagctgcacgtactttcgtgccacgcagcgccactcgggaaagacagtggtgcgctcgtcaggaagcaaccgtacctgccacccgcggttgtgcagggtgatcagatctatgctagtggccacctcgccccttaggggctcgttggtccagcacaagcgtcctcccttgcgcgagcagtatgggggtagtacatctagtaagttttcagatggagggtcagcgtcaatggtgaagatgccaggaagtaggacgtggttgaaatagtcaatgggagtgtcaacttgcaacagagcgcgttcccagtctcgaaccgctagggcgcgttcgtagggattgagcggcgagccccacggcatgggatgggtaagcgcggaggcgtacatgccacatatgtcgtaaacataaagaggttcacggagcaccccaatgtaagtgggatagcaacgtcctccgcgaatgctggccctgacataatcatacatttcatgtgagggggctagtagtccattgcctagatccgaacgcttaggttttacgctttggtacaagatctgtctaaagatggcgtgggagttggaggaaattgtgggcctttgaaaaacgttaaatttggcttcgggcagacccacggcatcacagatgaattgggcgtaggactctcgcagcttctgtaccaaggcggcggtgacaagcacatccaaagcgcagtagtcaagggtttcgcgtatcagatcataacgagactgttgcttcttttcccaaagttcgcggttcaggaggtactcctcgcggtccttccagtaatcttcggccggaaagccacgttcgtctgcacggtaggaacccaacatgtaaaattggttgacagctttgtaaggacagcagcctttttccaccggaagagcgtacgcttgcgcggcctttctcagagaggtgtgtgtaagagcgaaggtgtcgcgcaccatgactttgaggaattggtgtttaaagtcagtgtcgtcgcaggcgccctgctcccagaggtgatagtcggtgcgctttttggatagcggatttggtagggcaaatgtaatgtcattgaaaaggattttgccggcccgtggcataaagttgcgggtgattttgaaaggtccgggcacgtccgagcggttgttaatcacctgagccgccagcacaatttcatcaaagccgttgatgttatgtcccacaatgtagagttccacaaatcggggtgttccctgtagtttgggggccttttttaactcctcgtaagtaagattatcaggagaaaatagtcccatttcaagtcgggcccattcggccacttggggattggcagcaaggaacgcttgccacagctgggtggcaaaatgggtttgcaaacggtcgcggtagtttcgaaacttttttcctaccgctattttttcgggggtgaccacgtaaaaggtatggccgtcatttccccaggcatcccattgtagttcgtgggccagacggcaggcttcctccactagggtgtcatcccccgagagatgcataactagcataaacgggaccagttgcttaccaaaggctcccatccacgtgtaggtctcaacgtcgtaggtgacgaagaggcgttcaacgcggggatgagagccgatcggaaagaaattgatctcctgccaccagccggaggactgggcgttgatatgatgaaagtagaagtttctccggcggaccgtgcattcgtgctgatatttgtaaaagcgggcgcaatactcgcagcgttgcacgttctgcacctcttgaatgaggtgtacctggtgccctcgcacgagaaatcggagagggaaattaagaggctcctgagcgctctgcctttctccctcgttgttctcttctgcacctgcacgctcctgctgtgggaggatgacggagggagtgacgatgccccgcgaggcgcaggtccaaacctcgacgcggggaggctgaagcctgagagcgagagagcggatttgggagctgtccagggagtccaggaaggcttcgctgaggccggcgggcaaagaacgaaggttaacttgcagaaggcgggtaagggcggacgccaggcgttgatgaaacttaatttcaaggggggagttggtggaagtgtcaatagcgtagaggagaccttgtcctcgggaggctacaatggttcctcggaggcggaaggttgagggagggtttacatcatttgacgcggacgggcgcctgggggcagtggcggttcgggacccgcctgaagaggaggtagaagcacgttggcctggagctcgggtagcggttgatgctgagcccgcagctgactggcgtgcgcgacaacgcggcggttgagttcctggatacgtctttgttgagtgaagaccaagggtccccggactcggaacctgaaagaaagttcaacagaatcaatctccgcatcgttgaccgcgacctgacgcagaatttcctgcacgtcgcccgagttgtcttggtatgcgatctcggacataaactgatcgatctcttcctcctggagctccccccaaccggcccgctccacggtggccgcaagatcgttggagatgcgacccatgagctgggagaaggcgttaagcccgttttcgttccacacacggctgtagacaacgtcaccagtgtcgtcccgggcgcgcattaccacctgggccacgttaagctcaacgtgacgggcaaacacggcgtagttgcgcaagcgctggaaaaggtagttgagggtggtggcaatgtgctcacagacaaagaagtacataacccaacgccgaagagtcatttcgttgatattgccaagggcttccaagcgttccatggcttcgtaaaagtctaccgcaaagttgaagaattgggagttgcgggccgcgactgtcagctcgtcttgcaagaggcggattagctccgccacagtttctcgcacttcgcgttcaaaggcgcccggcgcttcctcgatttcttcttccatgagttcttcctcctctgcaacaggcacctcgggactcgcgggtgccggaacaggtcgtcggcggcgacgcctaatgggcagccgatcgacaaagcgttcgatgatttctccgcggcgacgacgcatggtttcagtgacggcgtgtccgttctctcggggtcgcagctcgaatacaccgccttgcaatcccgttccggagatgggtggtagcaggtggggtccttcgggcagagacagggcgctaactatgcatttgattatctgttgtgtaggcagagattgccaagcgttgttgagcaagtccaattggacgggatcagaaaacttttcaaggaaagcatcgagccaatcacagtcgcaaggtaagctcagaacggtgggctgtgggtttccacgggaggtgatgctgctgatgagatagttgaagtaggcggttttcaaacggcggatggtggcaaggaggataacgtcttttggtccggcctgttggatccgcaggcggtcggccatgccccaggcttcgctctgacatcgacgtagatccttgtagaagtcttgcatgagtctttccacgggaatttctatatctcctcggtcggccatgcgggtagagccgaacccgcggagaggctccaggagggccaggtcggcgaccactctttctgccagcacggcttgctgaatttgagtaagggtgttttggaagtcatctaagtccacaaagcggtgataagagccggtgttaatggtgtacgtgcagttggccatgacggaccagtttacaacttgcattccgggctgggtgatctctgtgtacctaaggcgggagtaggctcgggactcaaagacgtagtcgttgcaggttcgcaccaagtactggtagccaaccaggaagtgaggcggcggttcgcggtagaggggccatcgtagggttgctggggcgcccggcgcaaggtcctccagcataagacgatggtaatggtaaacatagcgagagagccaggtaattccggctgaggtggtcgcagcgcgggtgaactcgcggactcggttccagatgttgcgcaacggtgagaaacgctccatggtgggcacgctttggccggtaagacgggcgcaatcttgtacgctctagatggaaaaatagagagcaatcacggactcttctccgtagcctggaggatagaccgccagggtgcggtggcgaacaacccccggttcgagaccggctggatccgccactcccgacgcgccggccccgtgtccacgacggaaaccccgccgagacctagccgcggtccccggatctccagatacggaggggagtctttttgtcgttttttgtagatgcatccggtgttgcgacagatgcgtccgacgcagccaacgctcccgccccccactagcgcccaggccgccgtggctctttccggagccggcggtggcgaccctgacgaggaggccatgctggatttggaagagggcgagggtttggctcgcctgggagcaccctcccccgagcatcatccccgcgtacaacttaaaagggacgcacgtcaggcctacgtgccgccgcagaacctgtttagggatcgcagcggacaggaacccgaagagatgagggaccgcaggtttcatgcgggaaaggaactgcgggccggtttcaacagccaaagggtgctgcgcgccgaagactttgagcccgacaagcgtagtggagtaagtccggcacgggctcacgtgtcggcggccgatctggtgactgcgtacgagcaaactgtaaacgaggagcgcaactttcaaaaaacctttaacaatcacgtgcgcaccttagtagcgcgagaagaggtggccataggcctgatgcatttgtgggactttatggaagcgtacgtgcagaatccggcaagcaaaccgctgacggcacagctgtttttgattgtacaacacagccgcgataatgaaacttttcgagaagctatgcttaacattgctgagcccgaggggcgctggcttttagacctagtcaacatcctgcagagcatagtggtgcaagagcgcagcttgagcctggccgacaaggtggcggccattaattacagcatgctcagtctcggcaagttttacgcccgcaagatctacaaaactccttacgtgcccatagacaaggaggtgaaaattgatagtttttacatgcgtatggcgctgaaggtgttgacgctgagcgacgatctgggggtttaccgcaacgaccgcattcataaggccgtgagtgccagccgccgccgcgaactgagcgaccgcgagttgatgcacagcctgcgtcgagcattgacgggggccggcggggatgccaatgccgagtcttactttgacatgggggcagatttgcaatggcagccaagtgcccgggctctagaggcggttggataccgcaacgcaatgcaggaggaggatgaggaggaggactacgaggacgagccctgatcggccaggtggtgtttttgtagatgcagcggtcgacggcggtggtggacgggtcgcagcaggtggatcctgccatgttggcagcactgcaaagccaaccctcgggcgtgaccccctcagacgactgggcggcggccatggaccgtattctagctttgaccacccgcaatcctgaagccttcaggcagcagccccaggccaacaggttttcggccattttggaagccgtggtaccctctcgtactaacccaacccacgagaaggtgctggctatcgtgaacgccctaacagaaagcaaagcaattcgcaaggacgaagcgggactgatttacaatgctctgctggaaagggtggcccgatacaacagtaccaacgtacaagccaatcttgaccgccttaccactgacgtgagggaggcggtagcacagcgggagcgctttatgcatgacactaacttgggttcccaggtggcgctaaatgcttttctgagcacgctcccggctaacgttccgcgcggacaggaggattacgttagctttatcagcgcattgcgcctcctggtggcagaagtacctcaaagcgaggtttaccagtcaggtcccgattactttttccaaacttcgcggcagggactgcagacggttaacttgacacaggccttcaaaaacttgcagggcatgtggggtgtgcgggcccccgttggtgaccgcgccaccatttccagtttgctgacgcccaatacccggctgttgttgctgctgattgccccatttacaaatagtagtaccatcagccgggactcataccttggccatctgatcactttgtaccgcgaggctatcggtcagacacaggtagacgaacaaaccttccaggaaatcaccagtgtgagccgtgcgttaggacagcaagacaccgggagtctggaagccactttgaacttcctgctcaccaaccggcaacagaaaattccctcgcaattcacactgagtaccgaggaggagcgtatcttgcgttacgtgcaacagtctgtcagtttatacttaatgcgcgaggggatgaccccatcctcggctctggatatgacggcccgcaacatggaaccgtcgctgtattcgtccaatcggcctttcattaaccgcctaatggactacctgcatcgcgcggcagccatgaacagcgagtactttactaatgccattttgaacccccattggatgcccccctctggtttttatacgggagaatttgacatgcccgagggagatgacggcttcttgtgggacgacgtgtccgacagcatttttgtccctgcgcgttaccgcaagaaggaaggcggtgatgagctgcctttgcccttggtggaagcggcttccaggggccagagccctttcccaagcctcccatcgcttgttagcagcagcaacagcggacgggtgttgcgtccccggcttccaggggagacggactacctaaacgatcccctgttgcaacccgttcgtaataagaactttcctaacaacggggtggaaagtttggtagataaaatgaatcgctggaagacctacgctcaggagcagcgggagtgggaggagagccagtcccgccctttggccggccctttcagccgttggcgccggcgagaagacgaccaggatgactccgccgatgacaatagcgttttggacttggggggaactggtgcttcttccaaccccttcgcccacctacgtcctcagggccgcttgggcagattgtattaaaaaaaaaaaaaaaaaaaaaaaccacttaccagagccatggcaacagcgtcggtccctttgtgtgtttttcccctcttcccagtagcaaaatgagacgagcggtgggagtgccacccgtgatggcatacgcagagggtcctcctccttcttacgaaagcgtgatgggatcagcggattcgccggcaacgctggaggcgctctacgttcctccccgctacctggggcctacggaagggcgaaacagcattcgttactcagagttggcgccgctatatgacaccacccgggtttatctagtggataacaaatcggcagacattgcctccttgaactaccaaaatgaccacagcaactttcaaaccacggtggtgcagaacaatgacttcacaccagcggaggcggggacgcaaaccattaactttgacgagcgctcgcggtggggtgctgacctaaaaacaatcctgcgcacaaacatgcccaacataaacgagtttatgtctaccaacaagtttaaagctcggctaatggtagaaaaaaaaaataaggagactggtttaccgcgctacgagtggtttgagtttaccttgcccgaaggaaactactcggaaactatgaccattgatcttatgaataacgccattgtagacaactacttggaagtgggaagacaaaacggcgtgctagaaagcgacataggggtgaagtttgacacgcgcaatttccgtttgggttgggacccggtaaccaagcttgtcatgccaggcgtgtacaccaatgaagcgtttcatccggatattgttctattgccggggtgcggagtggattttacgcagagtcgtcttagtaatctgctgggaatccgtaagcggctgccgtttcaagaaggttttcaaatcatgtatgaggatttggagggaggtaacattccggccttgttagacgttgcaaagtatgaagctagcattcagaaagccaaagaggagggaaaagaaattggcgacgatacttttgcaacccgcccccaagatctggtaatcgaaccagtggcaaaagatagcaaaaatcgcagctacaatttgctgcctaatgatcaaaacaacaccgcatatcgcagctggtttttagcctacaactatggagaccccaagaagggagtgcaatcctggactttattgaccacagcggacgtcacgtgcgggtcgcagcaggtgtactggtctttacccgacatgatgcaagacccagtaacttttcgcccgtctacgcaagtcagcaactacccagtagtgggggttgaattgctgccagtacacgccaaaagtttctacaatgagcaggccgtttactctcagcttatccgccagtccaccgcgcttacacacgtcttcaatcgctttcctgagaatcagatactggtgcgtccgcccgctccgaccattaccaccgtcagtgaaaacgttcccgccctcacagatcacggaaccctgccgctgcgcagcagtatcagtggagtccagcgcgtgaccatcactgacgcccgccgtcggacctgtccctacgtgcacaaagccctgggcatagttgctccaaaagtgctttctagccgcaccttttaacatgtctattctaatctcgcccgataataataccggctgggggttgcactctgccggcatgtatggcggtgccaaaaggcgttccagccagcatcctgttcgtgtgcgagggcattaccgcgctccctggggggcccacacccggggcataatttccgcccgcaccaccgttgatgacgtgattgactctgtagtagccgacgctagacggtatcagcgacccacgtccacggtggattccgtgattgacagcgtggtagcagatgccaggcgctatgcgcagcgcaaaagccgtttgcggcgtcgccggcgacgacccacgactgccatgattgccgctcgagcggtgttaaggcgtgcgcgtcggataggacggcgagccatgcgccgagccgctgccgctgccagtgctggtcgagcccgccgtcaggccgctcgccaggctgccgcggccattgccagcatggcccagccccggcgagggaatgtctactgggtaagggacgcatcgggtgtgcgggtgccggtgcgaactcgaccccctcgaagttagaagacgattcaaaacgatggacgaagactgagtttccctatcgttgccagcatgagcaagcgcaagttcaaagaagagctgctggaggcccttgtgcccgaaatctatggccctgcggcggacgtcaagcccgacattaagccccgtgccctgaagcgtgttaaaaagcgggaaaaaaaagaggaaactgggttgttagatgatggtgtggagttcgttaggacctttgctcctcggcgacaggtgcagtggcgtggacgcaaagtgaagcgcgtgctccgacctggcaccactgtggtgttcactcctggcgagcggtctgccacacgggcattaaagcgggaatacgatgaggtttatgccgacgaagatattctggagcaggcagcccagcaaattggcgagttcgcctacggcaaacgcggtcgttacggagaggtggggctgttgctggatcaaagtaacccgactccaagcctgaagcccgcaacgcagcagcagattcttccagtaacggaaaccaaacggggcgtcaaaagggaaaacaaagacgaattgcagcctacaatgcaactcatggtgcccaagcggcagaagctggaggaagtgctggaaaatatgaaagtggacccaagcgttgagccggaagtaaaagtgcgccccattaaggaaataggtccaggtctgggagtgcaaacggtggatattcagatccccgtacgtaccactccagcagtggcaatggcagaagccatggaaacgcagacagatcagcctgcgcctgtgactacccgggaaataggtttgcaaacggacccaaggtacgagtctgttacttccacccgccgctcgcgcgtaagaaagtatacagccgccaactctatcctaccggagtatgccttacatccgtcaattacgccgacgcctggctatcgcggtacaatcttcagacccagccgccctcgaaccacccgccgtcgtcgcactacccggcgtcgatcgcgtcgcattacacccatctccgtgcaccgtgtaacccgccggggccgcacaattaccctgcccaatgcgcgttaccaccccagcattctcatttaattcgtccgctgccgtttttccagatggctctgacttgccggtttcgcatcccagtttcgtcctaccgaggaagatctcgccgtaggagaggcatgttgggcagcgggcgccgacgcgctttgcgcaggcgtatgaaaggcggatttttgcccgcgctgattcccattatcgccgccgccattggcgcaatcccaggcattgcctctgtggcgttgcaagcacgcaaacaataaaagaagcttgacactgactccctggtcctgactattttatacagacaagacatggaagacatcaattttgcgtcgctggcgccgcgtcacggctcgcggccgttcatgggcacctggaacgagatcgggaccagccagctcaacgggggcgctttcagttggagtagcctgtggagtggcattaaaaactttgggtcctccattaagtcctttggcaacaaggcctggaacagtaacactggtcagatgctgcgagataagttgaaggaccagaacttccaacaaaaagtggtggacggtctggcctcgggtataaatggcgtggtggatattgctaaccaggccttacaaaaccaaatcaatcagaggctggagaatagccgccaacctccagtagctctgaagcagcgaccaactcccgaaccagaagaggtggaagtggaagaaaaattacccccgttggaaacggcacctcccttgcctagcaagggtgagaaacggccgcgtcccgagctggaggaaaccctggttgtggaatcccgcgagcccccctcgtacgagcaggctttgaaagaaggagcttcgtatcccatgaccagacccattggctccatggccagaccggtttatgggaaagaaaaaactcccgtaacgttagaattgccaccacccgcgcccaccgtaccgcctatgccggctcccaccctgggtaccaacgttccccgccttgcggccccaaccgttgctgtggccactccggctcgcagagttcgcggtgccaattggcagagcactttgaacagcattgtgggtttgggagtgaaaagcctaaaacgccgccggtgctattaaagtggaaccaagctaaatacccttgttgtatgcgcctcctgtgttacgccagacagccgagtgacgggtcaccgccaagagcgccgcttgcaagatggccaccccctcgatgatgccgcaatggtcttacatgcacatcgccgggcaggacgcctcggagtatctgagtccgggcctggtgcagtttgcccgcgccaccgatacgtacttcagcctggggaacaagttcagaaaccccactgtggctccgacccacgatgtaaccacagacaggtcacagcgactgacgctgcgattcgtgccagtcgaccgcgaggacaccgcttattcttacaaagtgcgctttacgctggccgtgggcgacaaccgggtgttggacatggccagcacctactttgacatccgcggcgtgctggatcgtggccccagctttaaaccctactccggaaccgcctataactccctggctcctaaaacagcacccaatccatgcgaatggaaggacaacaacaaaataaaagttagaggacaagcaccccttataggaacaaacatagacaaagacaatgggattcagataggaacagacgcaacgacgaagcctatttatgccgacaaaacatatcaaccagagcctcaagtgggccaaacacagtggaacagtgaagttggtgccactgacaaggtagcgggtagggtattgaaagataccacgccaatgttaccatgctacgggtcttacgccaaaccaacaaatgaaaagggtggtcaggccaatcttataacaaacggaaccgatcaaactctaacaagcgacgttaacttacagttctttgccttggcaaacactcctaatgtgccaaaagccgttctttacgctgagaatgtggctattgaagcgcccgacacccatttggtgtacaagccagatgtagctcagggaaccgtaagttcggcagatcttttaacgcaacaggcagcgcccaacagaccaaactacattggctttagggataacttcattggcctgatgtactacaactccacaggcaatatgggcgtattggctgggcaggcttcacagctaaatgctgtagtggacttgcaagacaggaacactgagttatcgtaccaacttatgctggatgctcttggcgatcggagcagatatttttccatgtggaatcaggctgttgacagttacgaccccgacgtaagaatcattgagaaccacggagtggaggacgaattgccaaattactgctttccgctgggagggtctgcagctacagacacgtattctggcataaaagcaaacagcggaaactggactgcggacgacacttatgccgacagaggggcagaaattgagtctgggaatatttttgccatggaaatcaatttggcggccaatctctggcgcagcttcttatattccaatgtagccctgtatttgcctgactcatacaaaattacgccagacaacattacactacccgaaaacaagaacacctatgcctacatgaacggtcgggtggcggttcctagcgcccttgatacctacgtaaacatcggggcacggtggtctccagatcccatggacaatgttaaccccttcaatcaccaccgtaacgccggtctgcgctatcggtccatgctcttgggcaacgggcgttacgtacccttccacattcaagtcccccagaagttttttgccattaaaaatctcctcctgttacctggttcctacacctacgagtggaacttcaggaaggacgttaacatgatcctccagagcagtctgggtaacgacctgcgggtcgacggagccagcgtcaggttcgatagcattaatctgtacgccaacttttttcccatggctcacaacaccgcctccaccttggaagctatgctgcgcaatgacaccaacgaccaatcgtttaacgactacctttgcgctgcaaacatgctttatcccattccttctaatgctactagcgttcccatttctattccttcgcggaactgggccgcttttcggggctggagttttactcgactgaaaaccaaagaaaccccctctttgggttcgggatttgatccctactttacctactctggctccgttccatacttggatggtaccttttacctcaaccacacttttaaaaaggtgtccatcatgttcgactcctctgtgagctggcctggcaatgaccgactgcttacccccaatgagtttgaaatcaaacgcaccgtggatggggaagggtacaacgtggctcaatgtaacatgaccaaagactggtttctgattcagatgcttagtcactacaacattggatatcagggtttttatgtacccgaaagctacaaagatagaatgtattcctttttccgaaacttccagccaatgagtcgtcaggtggtaaacactaccacctacaaggaatatcagaatgttacccttcctttccagcataataactcaggctttgtgggatacatgggacccaccatgcgggagggacaagcttaccccgctaactacccttacccccttattggccaaacggccgtgccaagcctgacacagaaaaaattcctgtgcgatcgcaccatgtggcgcattccgttttccagcaacttcatgtctatgggggcactgaccgacctggggcagaacatgctgtatgccaattccgcccacgccctcgacatgacttttgaggtcgatcccatggatgagcccacacttctttatgttttgtttgaagttttcgacgtcgtgcgcatccaccagccccaccgcggcgtcatcgaggccgtctacctccgtacgccgttctcggccggtaacgccaccacataagaagctggccaatgggctccagcgagcaggagctggccgccatcgtgcgtgacctgggttgcggaccctactttctaggcacctttgacaaacgtttcccgggctttatggctccgaacaagctggcctgcgctattgtgaacacggccgggcgtgaaacagggggcgttcactggttggccctggcctggaaccccaagagccatacctgttacctctttgacccgtttggcttttcggacgagcggctcaaacaaatttaccagtttgaatatgagggcctactaaagcgaagcgctttggcttccacgcctgaccactgcattacccttgtgaaatctacccagaccgttcagggacctttttctgccgcctgtggtcttttctgctgcatgtttttgcatgcttttatacactggcccagtaatccaatggagcaaaatcccacaatggatcttctcacgggcgtacctaacagcatgcttcaaagcccccaggtcgaacccaccctgcgtcggaatcaggaacgattgtatcgttttttgacccaacactctccctactttcgtcgtcaccgcgagcgaattgaaaaagctacagcttttgatcaaatgaaaaatgctcaagtgttgtttcataataaaattttttattgatttcacgctggcagactttttttttttatttaaaagggctcaatctccgcatcgccgtgaccggtgggaagggccacgttgcgatattgcaaacgggtgctccacttgaattcgggaataatcaacttgggcaaagggtcttcgacgttttccttccaaaattgtcgtaccagctgcagggcgcttataacgtcaggcgcagaaattttaaaatcacaattggggccagcgctaccgcgcgaattgcggtatacgggattagcacactggaacactagcacacaggggtggagtatgctggcaagagccgacttgtcggtaacttcgttggtcttcagatcttccgcgccgctcaaagcaaatggggttaccttacacatctgccgacccaattggggtacaagatccttcttgttaagacactcacagcgcaaagggattaatatgcgttgctgaccgcgttgcatctgcgggtattcggcttgcagaaacgcttgcatttgtttaaatgctatttgggctttaagcccctccgaaaaaaacagcccgcaggacttgctagaaaacatgttgttgccacagctcacatcttccgcgcagcaccgcgcgtcgtcattcttgatttggaccacgctgcgaccccagcggttctgaacaactttggttttgctaggttgctccttgagggcgcgctggccattctcgctgccaacatctacctccacaacttgctccttctgtatcatttctcgcccgtggaagcatctcaacacgccttcctcccgggtacagccatgagcccaaacagcgcagccggttgtatcccagttgtggtgcttcaccccagcgtaggtttccacgtaggcagccaggaatcgacccatgagctctgtaaaggttttctgggtggtgaatgtcaaagacaatccgcggcgttcctcattcaaccaggtctgacatatcttgcgataaacggcgttttgttcaggaagaaacttaaaagctgttttttcgtcattctccacgtgatatttctccatcaggacgttcatgagctccatgcccttctcccaagccgaaaccaatgggtcaacctgggggtttgttatcagcatggtcactgccttggaagagccggattgattattttcttcctcttctggtggcgttagatccctggggataacggttttctccaaacgcctaatttgtcgcttgccattgcccttttgtactacttctacgcctggatagctgaacccgtggtacagcacctcttcgtcctcctcgctgtccggaaccacttcgggcgacaaggtcggagcgtgtacttgctccggtacttgcaagtttttgcgcagctttttcttgggaggcaatgacggagggcgctccgggctcgtctcctggaggtagggagtaacggtggggtgctctcgctgacggccagccatgctttactcctaggcgaaaaaaagatggaggaggatcttatacagccgcagccagactccgaaaccttaaccagccccacctctgaggtcggcgccgtcgaactagtggaacatgaggatgatgagcgagtggagcaagacccgggctatgtgacgccgcccaaggacggcaaggaatcggtgccggtgtcgccgctcaccgaagcagactacctgggaggggaggacgacgtgcttctaaaacatgtgttgcggcagagcaccattgtgcaggaggccttcaaggattactctgggtttccgctgacggtggaggagttgagtcggacctacgaagctaatctcttttcaccgcgtgtgcccccaaaaaagcaagccaatggaacctgcgagcccaatccgcgcctcaacttttatccagtttttgcagtccccgaagcgttggctacctatcatattttttttaagaaccaacgcatccccctatcatgtcgtgccaaccgcacccaaggagaccgcattttgcatctcaaagccggcgctcacatacctgagattgtttccttggaggaagttcccaagatatttgaaggtcttggcaaagatgaaaaacgggcagcaaacgctctgcaaaaaagtgaaaccgaaaatcagaacgttctggtggaactggatggcgataacgcgcgtctcgccgtgctcaaacgcaccatcgaagtttcccactttgcctaccctgctcttaaccttccccccaaagttatgcgttcagtcatggatcatctccttatcaagcgggtcgaacctttagattcagatcagcccgaacaaaactccgaggacggccagcccgtggtttctgacgacgatctcgcacgctggcttgacacccatgaccccaccactttgcaagaacggcgcaaaatgatgatggcggtcattctgattaccgttgagctcgagtgcttgcaacgcttctttgccaatccccagacgctgcgcaagattgaggaatccctccattatgctttccgtcatggctacgttcgacaagcgtgtaaaatttctaatgtagagcttagcaacttagtttcctacatgggaattttacacgaaaaccgcctggggcaaaacgttctccattgcactttgcaaggtgaggcccgccgcgactacgttcgcgactgcatttatcttttcctaatcctaacctggcaaaccgcaatgggtgtctggcaacaatgtctagaggagcgtaacctccgcgagcttgaaaaactgctggttcgaaatcgccgcgagctttggacagcttttagcgaacgcacggccgcttgccagctggccgatctgatttttcccgaacgactcatgcaaacgctgcaaaacggcttgccagactttgttagtcagagcattttgcaaaactttcgctcttttatcctcgagcgatccggtatcttaccggctatgagctgcgccctaccctccgatttcgttccactttgctaccgcgaatgcccgccgcctctctggagtcattgctatctcctccgcctggcaaactacctagcccaccactccgacctcatggaaaattccagcggcgaaggattgctagaatgccactgccgctgcaacctctgcacaccccaccgctctctggtctgcaataccgagctgctcaacgaaacccaagtaatcggtacctttgaaatccaaggaccagagcagcaagagggtgcttccaatcttaagcttactccggcgctctggacttcagcctatttgcgcaaatttattccagaggactatcacgcccaccaaattaagttctacgaagaccaatcccgacctcccaaagcccccctcacggcttgtgtcatcacccagagccaaattttggcccaattgcaagccatccagcaggcgcgacaggagtttctgctaaaaaaaggtcacggggtttacttggatccccagaccggtgaggaactgaataccccgtcaccctccgccgccgcttcgtgccgcccgcagaaacatgccgcccaaagggaacaagcaagccattgcggatcggcggtcccaaaagcaacagaaactgcaagagcagtgggacgaggaggaggaatcctgggacgacagccaggcagaggaagtttcagacgaggaggaaatggagagctgggaaagtctagacgaggagctggaggacaaaccccccaaggacgaggaggaagaaatcatcgccagcgctgcggcgccgtcttccaaagaacccgctcggagccagcctccgacggggaaagtcggaccgtccccgccgcggccaggcttgttgaaagccagccgtagatgggacaccgtttccatcgcaggatctccaccagccccagttggtaagcagcccccgcaaactcggcgggggtattgttcctggcggccctacaaaagcaatatcgtcgcctgcctccagcactgccggggcaacatctcctttgcgcgacgatacttgctattccatgacggggtggcggtccctcgcaacgttctctactattaccgtcatctctacagcccctacgaaacgctcggagaaaacaactcggccgcgtaaggaaaagacttccgccattgctactcgccaggatacaccagtcgcgcaggaactaagaaaacgcatctttcccacgctgtatgctattttccagcagagtcgcggccagcagttggaactgaaagtaaaaaaccgctccctgcgttcgctcacccgcagctgcttgtatcacagaagggaagaccaactgcagcgcacgctggaagacgccgaggcactgttcaataaatactactcggtgtcttttaaggactgaaaagcccgcgcttttttaagaaccagattacgtcatcaccatgagtaaggaaattcccacgccttacatgtggagctatcagccacagatgggcttggcagctggagcatctcaggactactctagtcgcatgaactggctaagtgccggcccccatatgattgggcgcgtaaatggaattcgcgccactcgaaaccaaattttgctggagcaagctgccctgacctccaccccgcgaagtcaattgaacccgcccaattggcccgctgcccaggtgtatcaggaaaaccccgctccgaccacagttctcctgccacgcgacgctgaggccgaagtccagatgactaactccggagcgcaattagcgggcggatccagacacgtcaggttcagaggtcggtcctcgccctactctccaggtcctataaagaggctgattatccgaggccggggtatccagctcaacgacgaagtggtgagctccttagccggcctccgacctgacggagttttccagcttggaggtgccggccgctcctccttcactcctcgccaggcgtacctgacactccagagctcttcttcccagcctcgctccggcggcattggaaccctccagtttgtggaggagtttgtaccctccgtttacttcaacccattctcgggcgctcctggtctttacccagacgacttcatcccaaactacgacgcggtgagcgaatctgtggacggctacgactgaatcccaatggtgcgtccgtgactgtgtggctgcaacatctacatcggcgccttaatccttgctactttgtctgaaaagtctgtgatttttatttaccgccccagcgcttggattacatgaagatctgtgttcttttttgtgtgctaagtttaacaagtagcctaaagacttcacctacagccgttggttctttacgtcagctgcaagattccaacaaaggtacacaccaaactctttatttttctgagtctaccacttctattgcacttaactgttcttgtcgtaaccaactcgttcagtggcgcgctaacagacaattttgcaaactattttgggacgctcttattgttcaaggaaacaacagcctttgtaacaactgtactgctactactttaactcttacacctccttttgttcccggtccatacttgtgcattggcacaggaagagggcctagctgctttaatcgctggactttacaaaaagagaacctaaccactaccaccctccttccccttactacttatactttttcccaaaaaaaaatttactttttgcccattattgcacttttggcctttgtctgtgttattaccgctaattacattttaattttcaatcttgataatttttactaatcatgctgctgtttttactttgccttcttttctgctctgcctatgccgccgtgccagaaaaaactcttaacaacctcgttcgggtgtacgccttagttggtaccaatctatcccttgattctatgaaaactcctcagattgacgaacttactagtcttagctggattaaacaggaagacaatcctaacaaaaacttacaatcatttttttttattggtcaaaaactctgtgaagttaccaaagacaaaatcactgtttttaactattatccgttggaattttcctgcgctaacgtaaccttgtatttgtataatcttaaaactgacgattctggcctctataatggaaaggcccataccaaagagcttgaacataacacctatgttaggctttatgttattgacattcctccgcctaagtgtgacattacttcacgttacttaggcatacaggctactggggaagattattgtttaattgaaatcaattgcactaactccaaatacccagctgtggttaaatttaatggcaggcaaagcaacttctaccattatgttagcgaaaacggaaacaaagaacttccaaatttttatgaaacacacatcactattaatggtacccacaaaagctttcactttaattacccttttaacgacctttgtcaaacaaccagcgctctacaatataatgacaatgtccaggtagtcctcattcttctcatagtagttggcttaataataatttccgctagtttaatattgctttattgccaccgcaaaaaaatcaaggccgaagttcaacatcaaccagtgcatatttgtttagaaaaataaaatttttttcttttcagtatggtaactcctcttctcctgcttgtctgtctgccaattatctacgcctccaccaccttcgccgcagtctcccaccttgatacggattgtcttcccgccttgctgacttatctcatcttcacctctgtttgctgcactgccatctgcagcattgccactttttttgtggccattttccaaactgcggactacctatacgttagagtggcatactatcgtcatcatccccaatataggaaccacgaggtggccgcccttctgtgcctgtcatgaaagttcctcttctctgtcttatcctcctttacaaagtcctggccaactgccacctccaccggcccaccgagttcctgcgctgctactcaacagaaacctcttccttttggctgtactccattatttttattttgattttctttgccacctttttgggattacaaatttacggctgccttcacctgggctggatgcatcctcccaacaacctacccagatttcctggtttcttattacagcccccgccgcccccaccagctcctgtacagcgcgctccatcagttattagctactttcatcttaactctgaagatgtctgaccaactagaaatcgacgggcagcgcactgagcagctgatccttgctcggcgaaaactcaaacaacaaaaccaggaattgttcaaccttcaagccttacaccaatgcaaaaagggtcttttctgcctggttaaacaagctgaactttgctatgatgtaacccaacaggggcatgagctatcatacactttaaacaagcaaagacagagctttatgactatggtgggggttaagcccattaaggttactcagcaatccggcccagttgagggaagcattctttgtcagtgcaccaattctgaatgcatgtacactatggtaaaaaccctgtgtggtctcagggaacttctcccctttaattaaagttatctgattaataaagcttaccttaaatttgatatcagttgtttgtcaagtttttccagcagcaccacctgcccttcctcccaactttcgtaggggatgtgccaacgggcagcaaactttctccacgtcctaaagggtatatcggtgttcacctttttaccctgacccacgatcttcatcttgcagatgaaaagaaccagaattgaagacgacttcaaccccgtctacccctatgacaccttctcaactcccagcatcccctatgtagctccgcccttcgtttcttctgacgggttacaggaaaaacccccaggagttttagcactcaagtacactgaccccattactaccaatgctaagcatgagcttactttaaaacttggaagcaacataactttagaaaatgggttactttcggccacagttcccactgtttctcctccccttacaaacagtaacaactccctgggtttagccacatccgctcccatagctgtatcagctaactctctcacattggccaccgccgcaccactgacagtaagcaacaaccagcttagtattaacgcgggcagaggcttagttataactaacaatgccgtagcggttaatcctaccggagcgttaggcttcaataacacaggagctttacaattaaatgctgcaggaggaatgagagtggacggtgccaacttaattcttcatgtagcatatccctttgaagcagtcaaccaactaacactgcgattagaaaacgggttagaagtaaccagcggaggaaagcttaacgttaagttgggatcaggcctccaatttgacagtaacggacgcattgctattagtaatagcaaccgaactcgaagtgtaccatccctcactaccatttggtctatctcgcctacgcctaactgctccatttatgaaacccaagatgcaaacctatttctttgtctaactaaaaacggagctcacgtattaggtactataacaatcaaaggtcttaaaggagcactgcgggaaatgcacgataacgctctatctctaaaacttccctttgacaatcagggaaatttacttaactgtgccttggaatcatccacctggcgttaccaggaaaccgacgcagtggcctctaatgccttaacatttatgcccaacagtacagtgtatccacgaaacaaaaccgctgacccaggcaacatgctcatccaaatctcgcctaacatcaccttcagtgtcgtctacaacgagataaacagtgggtatgcttttacttttaaatggtcagccgaaccgggaaaaccttttcacccacccaccgctgtattttgctacataactgaacaataaaatcattgcaggcacaatcttcgcatttctttttttccagatgaaacgagccagacttgaagatgacttcaaccccgtctacccttacgaacactacaatccccttgacatcccatttattacacccccgtttgcctcctccaacggcttgcaagaaaaacctccgggagtcctcagcctgaaatacactgatccacttacaaccaaaaacggggctttaaccttaaaactgggcacgggactaaacattgatgaaaatggagatctttcttcagatgctagcgtggaagttagcgcccctattactaaaaccaacaaaatcgtaggtttaaattacactaaacctctcgccctgcgaagtaacgcgctcactctttcttacaacgctcccttaaacgtagtaaataacaatttagctctaaatatctcacaacctgtcactgttaatgcaaacaacgaactttctctcttaatagacgccccacttaatgctgacacgggcactcttcgccttcaaagtgctgcacctcttggactagtggacaaaacactaaaagttttgttttctagccccctctatctagataacaactttcttacactagccattgaacgcccgctagctctatccagtaacagagcagtgacccttaagtattcaccacctttaaaaatagaaaacgaaaacttaaccctaagcacaggcggaccttttactgtaagcgggggaaatctaaacttaacaacatcggcacccctctccgtgcaaaacaactctctctccttattcattacttctcctttaaaagttattaattctatgttagctgttggggttaacccgccttttaccatcactgactctggattagctatggacttaggagacggtcttgcactaggtggctctaagttaataatcaatcttggtccaggtttacaaatgtctaatggagccattactttagcactagatgcagcgctgcctttgcaatatagagacaaccaacttcaactcagaattggctcaacgtctggcttaattatgagcggagtaacacaaacattaaacgtcaatgccaataccggcaaaggtcttgctgttgaaaacaactcactagttgttaagcttgggaacggtcttcgctttgatagctggggaagcataactgtttcgcctactaccactacccctaccaccctatggaccaccgcagacccgtctcctaacgccactttttatgaatcactagacgccaaagtgtggctagttttagtaaaatgcaacggcatggttaacgggaccatatccattaaagctcagaaaggcattttacttagacctacagctagttttatttcctttgtcatgtatttctacagcgacggaacatggagaaaaaactatcccgtgtttgacaacgaagggatactagcaaacagtgccacgtggggttatcgacaaggacagtctgccaacactaacgtttctaatgctgtagaatttatgcctagctctaaaagatatcccaatcaaaaaggttctgaagttcagaacatggctcttacctacacttttttgcaaggtgatcctaacatggccatatcctttcagagtatttataatcatgcattagaaggctactcattaaaatttacctggcgcgttcgaaataatgaacgttttgacatcccctgctgctcattttcttatgtaacagaacaataaaatattgttgtttttgtttttataactttattgatacttttacagaattctaaccgttaatccccctccccccttccactttatcttatacacctccctctccccctgtaccgccgcaaacaactgcaatttagaatttacacaacaattcttctgtgacaaaattaacacaggttctttgctggcaaagcgctgatccgtaatggaaatgaaaccttcggaaacatcgtccaacagcacggtggagtccaaagcagagctctgcaaaaacacaatacagtcaagctctccacgggttttcgcctctgttgtagtctgccaacgtaaacgggcagtaccgttccattaagccccgcagtaatccctgtctccggggttccaccaagcttttcagaagtgacctaacggtgaagcttcccaaaactttcaccgccttggcgagcaaccgccgcgtccgacgggcacagcatcgcacagaaagctcatccaagtttttacaataggtacagcccaacaccaccatattattcatgattccataactaaaaaaactccacccaaatgacatgcgctccaacactatagccgcatgcccatcatacagcaagcgaatatacataatatgtctacctctgacaaacacgctccccataaataacacttccttgggcatgccacagtttacaatttctcgataccaagggaatctcaagttatacagtgaaccataaatcatcattttaaaccagtttgctaacactacaccgcccgccttacattgaagagacccaggtttattacagtgacagtgtatagtccagcgctcaaaacctcttacaatttgattaaaatcaacattaagagtggcacaacaaacacaaacacgcatgtaaattctacacacatgcttttcccatttagacagtatcatgtcccaccacattggccattcctgcaatactataaagggagcacaagatggaatagacctcacctcgctcacataatgcatattcaaatgttcacactctaaaagtccaggagtcctttccattgtggcaatgggcacaaaatcctcagagggaggtggaaggcggtgggtttggtacgaactcagtttgtagcgaaaccatctgtcgcgttgcatcataaattaaaagctcgcgcacagcttcgtacttctgttttaaaaagcgaacacgctgccaacaaatgttcgcaaaccgacggtttcgttggcgcgctctttcagttttcagggcagtgttcagccactcctgcagtccacttaacagctcctcagcccgtggagatatgctgacatcataccttattatgtccccataaacgttcaaacagcaggttaaagccaactccaaccaagcaatacaaaggccttgatcccgactcactggaggtggagggagagacggaagaggcataattattccagacggttgtaaagccagccaaagtgcaagtcacgaagatcacacctctccccaccgctgcgttggtaaaaaattacagccaagtcaaaaaagatgcgattttccaaattaccaatcaccgcttccactaaggctggcacacgcacttcaagaaacacaaacatagcaaaagcattttcctcaaaatcttcaaacattaagctgcaatcttgaataactcccaaataattttctgcttgccacccgcgcaacacatccattaaaatttcttgtagactggcgccatgcaattcaaaaagcttgttgagagcgccctctactgtcatacgcaggcacaccttcatggttgaaaaagatcaggttcccgtgtcacctgcagttcatttaaaagatcaacatcaggctcaaaaccccgatcccgaatctccgtgcgtagcattaattgtacaaagtcatccaaatcattgcatataagctctgtcagttcgctatcaggaagcagctcaggcgatgctacacaacaaatcatttctagcgtgggagctaaagacgttaaagtaaagccacaataagcagcttgaaaaactggagtaacacaatgtaaaatgtgcagcaaaaactccgacatgtttgtctttaaaaaatctaccacagaaatgtccatattatttaaataaaacatcaggggctgaggaaccaccaccgaaataaaaataggtcgtaacaaaaacattgtgtcctgcaacaaaaaaaaatattaatgcccaaagcacctaggaaaaccttatgcctccctttatacccgctgccccgtcttaccgcgacaaagcacacagaacaaaacacactacacagacgcacacaatatttatacactccctttatcgtcaaaagtccacaaaaactccaaaggtcacaaaaacccgcgcaaaaaacaccgccaacgtaacacgtccgccgcgccactccccaaccttcgaccccaacgtcattcacctccaccctttcccaccccgcctacctatacgtcacttcgcaccacccctagcccctcctcactcattatcatattggctcgtttccagctttaaggtatattattgatgatg

SEQ ID NO: 1412 - protein, 866 aa, Escherichia coli
  MISC_FEATURE (1)..(866): Escherichia coli K12
MSTKPLFLLRKAKKSSGEPDVVLWASNDFESTCATLDYLIVKSGKKLSSYFKAVATNFPVVNDLPAEGEIDFTWSERYQLSKDSMTWELKPGAAPDNAHYQGNTNVNGEDMTEIEENMLLPISGQELPIRWLAQHGSEKPVTHVSRDGLQALHIARAEELPAVTALAVSHKTSLLDPLEIRELHKLVRDTDKVFPNPGNSNLGLITAFFEAYLNADYTDRGLLTKEWMKGNRVSHITRTASGANAGGGNLTDRGEGFVHDLTSLARDVATGVLARSMDLDIYNLHPAHAKRIEEIIAENKPPFSVFRDKFITMPGGLDYSRAIVVASVKEAPIGIEVIPAHVTEYLNKVLTETDHANPDPEIVDIACGRSSAPMPQRVTEEGKQDDEEKPQPSGTTAVEQGEAETMEPDATEHHQDTQPLDAQSQVNSVDAKYQELRAELHEARKNIPSKNPVDDDKLLAASRGEFVDGISDPNDPKWVKGIQTRDCVYQNQPETEKTSPDMNQPEPVVQQEPEIACNACGQTGGDNCPDCGAVMGDATYQETFDEESQVEAKENDPEEMEGAEHPHNENAGSDPHRDCSDETGEVADPVIVEDIEPGIYYGISNENYHAGPGISKSQLDDIADTPALYLWRKNAPVDTTKTKTLDLGTAFHCRVLEPEEFSNRFIVAPEFNRRTNAGKEEEKAFLMECASTGKTVITAEEGRKIELMYQSVMALPLGQWLVESAGHAESSIYWEDPETGILCRCRPDKIIPEFHWIMDVKTTADIQRFKTAYYDYRYHVQDAFYSDGYEAQFGVQPTFVFLVASTTIECGRYPVEIFMMGEEAKLAGQQEYHRNLRTLSDCLNTDEWPAIKTLSLPRWAKEYAND

SEQ ID NO: 1413 - DNA, 36964 bp, Adenovirus B11
  MISC_FEATURE (1)..(36964): Adenovirus B11 variant
ggccagtgaattgtaatacgactcactatagggcgaattgggccctctagatgcatgctcgagcggccgccagtgtgatggatatctgcagaattcgcccttccttaattaacctgcaggttacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcattcgctaccttaggaccgttatagttacgattaccctgttatccctaggccggccgtttaaaccctgcaggatttaaattaattaagcgatcgcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagcgatcgcgtttaaacaagggcgaattccagcacactggcggccgttactagtggatccgagctcggtaccaagcttgatgcatagcttgagtattctatagtgtcacctaaatagcttggccatcatcaataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgagaaattggtatttgaagtcgatgtcgtcacaggctccctgttcccagagttggaagtctacccgtttcttgtaggcggggttgggcaaagcgaaagtaacatcattgaagagaatcttaccggctctgggcataaaattgcgagtgatgcgaaaaggctgtggtacttccgctcgattgttgatcacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggatttgcatgtaggaatgatgaccaaagatctaccgccagtgctgtttgtaactggtcccgatactgacgaaaatgccggccaattgccattttttctggagtgacacagtagaaggttctggggtcttgttgccatcgatcccacttgagtttaatggctagatcgtgggccatgttgacgagacgctcttctcctgagagtttcatgaccagcatgaaaggaactagttgtttgccaaaggatcccatccaggtgtaagtttccacatcgtaggtcaggaagagtctttctgtgcgaggatgagagccgatcgggaagaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagttgtacctggcttcccttgacgagaaatttcagtgggaagccgaggcctggcgattgtatctcgtgctcttctatattcgctgtatcggcctgttcatcttctgtttcgatggtggtcatgctgacgagcccccgcgggaggcaagtccagacctcggcgcgggaggggcggagctgaaggacgagagcgcgcaggctggagctgtccagagtcctgagacgctgcggactcaggttagtaggtagggacagaagattaacttgcatgatcttttccagggcgtgcgggaggttcagatggtacttgatttccacaggttcgtttgtagagacgtcaatggcttgcagggttccgtgtcctttgggcgccactaccgtacctttgttttttcttttgatcggtggtggctctcttgcttcttgcatgctcagaagcggtgacggggacgcgcgccgggcggcagcggttgttccggacccgagggcatggctggtagtggcacgtcggcgccgcgcacgggcaggttctggtactgcgctctgagaagacttgcgtgcgccaccacgcgtcgattgacgtcttgtatctgacgtctctgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctttcgacggtggccgcgaggtcattggagatacggcccatgagttgggagaatgcattcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcaatgtgttcggcgacgaagaaatacatgatccatcgtctcagcggcatttcgctaacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccgggatctcttcttcctcttctatctcttcttccactaacatctcttcttcgtcttcaggcgggggcggagggggcacgcggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcctagcaaggacaacatcgtaacgttctccattgcttattgcttgtgcgcttgccttcttactgctttactgtgcgtatgcatacacctgcttgtaaccactcgcatcaaaaacgccaataacaaagaaaaaatgccttaacctctttctgtttacagacatggcttctcttacatctctcatatttgtcagcattgtcactgccgctcatggacaaacagtcgtctctatccctctaggacataattacactctcataggacccccaatcacttcagaggtcatctggaccaaactgggaagcgttgattactttgatataatctgcaacaaaacaaaaccaataatagtaacttgcaacatacaaaatcttacattgattaatgttagcaaagtttacagcggttactattatggttatgacagatacagtagtcaatatagaaattacttggttcgtgttacccagttgaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaatttctttttatacagccatggtttccactaccacattccttatgcttactagtctcgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcattatcgctgcagtgacaattggaatatctattcttgtttttaccataacctactacgcctgctgctatagaaaagacaaacataaaggtgatccattacttagatttgatatttaatttgttctttttttttttatttacagtatggtgaacaccaatcatggtacctagaaatttcttcttcaccatactcatttgtgcatttaatgtttgcgctactttcacagcagtagccacagcaaccccagactgtataggagcatttgcttcctatgcactttttgcttttgttacttgcatctgcgtatgtagcatagtctgcctggttattaattttttccaacttatagactggatccttgtgcgaattgcctacctgcgccaccatcccgaataccgcaaccaaaatatcgcggcacttcttagactcatctaaaaccatgcaggctatactaccaatatttttgcttctattgcttccctacgctgtctcaaccccagctgcctatagtactccaccagaacaccttagaaaatgcaaattccaacaaccgtggtcatttcttgcttgctatcgagaaaaatcagaaattcccccaaatttaataatgattgctggaataattaatataatctgttgcaccataatttcatttttgatataccccctatttgattttggctggaatgctcccaatgcacatgatcatccacaagacccagaggaacacattcccctacaaaacatgcaacatccaatagcgctaatagattacgaaagtgaaccacaacccccactactccctgctattagttacttcaacctaaccggcggagatgactgaaacactcaccacctccaattccgccgaggatctgctcgatatggacggccgcgtctcagaacagcgactcgcccaactacgcatccgccagcagcaggaacgcgcggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccacggtagcatatgcaaatcccaaccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattattgatgatg

SEQ ID NO: 1414 - DNA, 33323 bp, Adenovirus D8
  MISC_FEATURE (1)..(33323): Adenovirus D8 variant
gccaagctatttaggtgacactatagaatactcaagctatgcatcaagcttggtaccgagctcggatccactagtaacggccgccagtgtgctggaattcgcccttgtttaaacgcgatcgcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgcgatcgcttaattaatttaaatcctgcagggtttaaacggccggcctagggataacagggtaatcgtaactataacggtcctaaggtagcgaatgatgtccggcggtgcttttgccgttacgcaccaccccgtcagtagctgaacaggagggacagctgatagaaacagaagccactggagcacctcaaaaacaccatcatacactaaatcagtaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaacctgcaggttaattaaggaagggcgaattctgcagatatccatcacactggcggccgctcgagcatgcatctagagggcccaattcgccctatagtgagtcgtattacaattcactggcccatcatcaataatataccccacaaagtaaacaaaagttaatatgcaaatgagcttttaaattttaacggttttagggcagggccaacgttaattggttaataagcggtaatgcagttgacgtcaagacgtacggccggcggttgccgcaaaggcgtggcccaacccggaagcaagtcgcggggccgatgacgtataaaaaagcggactttaaacccggaaacggccgattttcccacggccacgcccggatatgaggtaattttgggcggttgcaaataaaattaggacatggtggcgccaaaactgaatgaggaagtgaaaagcgaaaaataccggtcccgcccagggcggaatatttaccgagggccaacagactttgaccgattacgtggggtttcgattacggtgttttttttcgccaatttccgcgtccgtgttaaatccggtgtttatgttacacatcagctgatccacagggtatttaaaccagttaagcccgtcaagagactactcttgagtgccagcgagtagagttttctctaaactttgcttttaaagtttaagaaaaatgagacacctgcacctcctgtcttcaactgtgcctattgacatggccgcattattgctggaggactatgtaaatacaatattggaggacgaactgcatttatctccgtttgagctgggacccacacttcaggacctatatgatttggaggtaaatgcccaggagaacgacccaaacgaagaggctgtgaatttaatatttccagaatctatgattcttcaggctgacatagccagcgaagctgtacctacttcagtttatacaccgactctgccgcctatacctaaattggaagaggaggataagctagaccttcggtgttatgaggaaggttttcctcccagcgattcagaggacgaacggggtgagcagagcatggctataatctcagactatgcgtgtgtggttgtggaaaatcattttgtgttggacaatcctgaggtgccagggcaaggctgtaaatcctgtcaatatcaccgggaacagaccggagacccaaatgcttcctgcgctctgtgttacatgaaaatgagcttcagctttatttacagtaagtggagtaaatgtaagagaggctaagtgcttaagacattactgtgctttacttgaacagctgtactaagtgtggtttatttttggtactaggtccggtgtcagaggatgagtcatcacctttagaagaagaccacccgtctccccctgatcttacaaatgacacgcccctgcaagtgcgcagacccaccccggttagaccgagtggcgagaggcgagcggctgtttacaaaattgaggatttgttgcaggacgtgggtgggaatgaacctttgaacctgagcttgaaacgccccaggaactaggcgcagctgtgcttagtcatgtgtaaataaagttgtgcaataaaagtatgtgtgacgcatgcaaggtgtggtttatgactcatgggcggggcttagtcctatataagtggtaacacctgggcacttaggcacaaacgttaggaaattcctaatggatgtgtggagtattcttggggaatttaacaagacacgccggcttgtggaggatagttcagacgggtgctccgggttttggagacactggtttggaactcctctatctcgcctggtgtacacagttaagaaggattatagcgaggaatttgaaaatctttttgccgactgctctggcctgctagattctttaaattttggccaccagtcccttttccaggaaagggtactccacagccttgatttttccagcccagggcgcactacagccggggttgcttttgtggtttttttggttgacaaatggagccaggacacccaactaagcaggggctacattctggactttgcagccatgcacctgtggagggcctggatgaggcagcggggacagagaatcttgaactactggcttctacagccagcagcttcgggtcttcttcatctacacagacaaacatccatgttggaggaagaaatgagggaggccatggacaagaacccgaggagcggcctggaccctccgtcggaagaggagctggattaaatgaggtatccagcctatacccagagcttagcaaggtgctgacatccatggccaggggagtgaagagggagaggagcgatgggggcaatactgggctgatgacccagctaactgccagcctgatgaatcgcaagcgcccagagcgtattacctggcacgagctacagcaggagtgcagggatgagataggcctgatgcaggataaatatggcctggagcaaataaaaacccattggttgaacccagacgaggattgggaggaggccattaagaaatatgccaagatagccctgcgcccagattgcaagtacagggtgactaagaccgtgaatattaaacatgcctgctacatctcggggaacggggcagaggtggacatcgatactctggacaagtcagccttcaggtgttgcatgatgggaatgagagcaggagtaatgaatatgaattccatgatctttataaacataaagttcaatggagagaagtttaatggggtactgtttatggccaacagccacatgaccctgcatggttgcagtttttttggctttaacaatatgtgtgcagaggtctggggtgctgctaagattaggggatgtaagttttacggctgctggatgggcgtggttggaagacccaagagcgagatgtctgtaaagcagtgtgtgtttgaaaaatgctacctgggagtctgtaccgagggcaatgctagagtaagacactgctcttccctagagacgggctgcttttgcctggtgaagggcacagcctcgattaagcataatgtggtaaagggctgcacggatgagcgcatgtacaacatgctgacctgcgactcgggggtctgccatatcctgaagaacatccatgtgacctcccaccccagaaaaaagtggccagtgtttgagaataacctgctgattaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcggtggcagacacaccaggatgcagccagtggccctggatgtgaccgaggagctgcgaccagaccacctggtgatggcctgtaccgggaccgagttcagctccagtggggaggacacagattagaggtaggtttaagtagtgggcgtggctaaggtaagtataaaggcgggtgtcttacaagggtctttttgcttttctgcagacatcatgaacgggaccggcggggcctttgaaggggggctttttagcccttatttgacaacccgcctgccgggatgggccggagttcgtcagaatgtgatgggatcaacggtggacgggcgcccagtgcttccagcaaattcctctaccatgacctacgcgaccgtggggacgagctcgtcgcttgacagcaccgccgcagccgcggcagccgcagccgccatgacagcgacgagactggcctcgagctacatgcccagcagcggtagcagcccctccatccccagttccatcatcgccgaggagaaactgctggccctgctggctgagctggaagccctgagccgccagctgaccgccctgacccaggaggtgtccgagctccgcgaacagcagcagcagcaaaataaatgatttaataaacacagattttgattcaaacagcaaagcatctttattatttattttttcgcgcgcggtaggccctggtccacctctcccgatcattaagagtgcggtggattttttccaggacccggtagaggtgggattggatgttgaggtacatgggcataagcccgtcccgggggtggaggtagcaccactgcatggcctcgtgttctggggttgtgttgtagatgatccagtcatagcaggggcgctgggcgtggtgctggatgatgtccttaaggaggagactgatggccacggggagccccttggtgtaggtgttggcaaagcggttgagctgggagggatgcatgcggggggagatgatgtgtagtttggcctggatcttaaggttggcgatgttaccgcccagatcccgccgggggttcatgttgtgcaggaccaccaggacggtgtagcccgtgcacttggggaacttgtcatgcaacttggaagggaaagcgtggaagaatttggagacgcccttgtgcccgcccaggttttccatgcactcatccatgatgatggcaatgggcccgtgggctgcggctttggcaaagacgtttctggggtcagagacatcgtaattatgctcttgggtgagatcatcataagacattttaatgaatttggggcggagggtgccagattgtgggacgatggttccctcgggccccggggcgaagttcccctcgcagatctgcatctcccaggctttcatctcggagggggggatcatgtccacctgcggggcgatgaaaaaaatggtttccggggcgggggtgatgagctgcgaggagagcaggtttcttaacagctgggacttgccgcacccggttgggccgtagatgaccccgatgacgggttgcaggtggtagttcaaggagatgcagctgccgtcgtcccggaggaggggggctacctggttaagcatgtctctgacttggaggttttcccgaacaagctcgctaaggaggcggtccccgcccagcgagagcagttcttgcagggaagcaaagttttttaggggcttaagcccgtcggccatgggcatcttggcgagggtgtgcgagaggagctccaggcggtcccacagctcggtgacgtgctctacggcatctggatccagcagacttcctcgtttcgggggttgggacgactgcgactgtagggcacaagacgatgggcgtccagcgcaaccagcgtcatgtccttccagggtctcagggtccgcgtgagggtggtctccgtcacggtgaaggggtgggccccgggctgggcgcttgcaagggtgcgcttgagactcatcctgctggtgctgaaacgggcacggtcttcgccctgcgcgtcggcaagatagcagttgaccataagctggtagttaagggtctcggcggcatggcccttggcgcggagcttgcccttggaagagcgcccacaggcgggacagaggagggattgcagggcgtagagtttaggcgcgagaaaaacggactctggggcaaaggcatccgctccgcagtggacgcagacggtctcgcactcaacaagccaggtgagctcgggctgcttggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtaaagaaactcggaccactctgagacaaaggcgcgcgtccacgccaagacaaaggaggccacgtgcgaggggtagcggtcattgtccaccagggggtccaccgtttccaccgtgtgcagacacatgtccccctcctccgcatccaagaaggtgattggcttgtaggtgtaggccacgtgaccgggggttcccgacggaggggtataaaagggggcgggtctgtgctcgtcctcactctcttccgcgtcgctgtccacgagcgtcagctgttggggtaggtattgcctctcgagagctggcatgacctcggcactcaggttgtcagtttctagaaacgaggaggatttgatgttggcctgccctgtcgcaatgcttttcaggagactttcatccatctggtcagaaaagactatttttttattgtcaagcttggtggcaaaggagccatagagggcgttggagagaagcttggcgatggatctcatggtctgatttttgtcacggtcggcgcgctccttggccgcaatgttgagctggacatattcgcgcgcaacgcacttccattcgggaaaaacagtggtgcgctcgtcgggcacaatcctgacgcgccagcctcggttatgcagggtgaccaggtccacgctggtggccacctcgccgcgcaggggttcgttggtccagcagaggcgcccgcccttgcgcgagcaaaaaggtggtaacacatcaagcaaatgctcgtcaggggggtccgcatcgatggtgaagatgcccggacagagttccttgtcaaaataatcaatttttaaggatgcatcatccaaggccatttgccacttgcgggcggccagggctcgctcgcaggggttcaggggcggaccccagggcatgggatgcgtaagcgcggaggcgtacatgccgcagatgtcatacacatagatgggctccgagaggatgccgatgtaggtgggataacagcgccccccgcggatgctggcgcgcacgtagtcatacaactcatgcgagggtgccaagaaggcggggccaagattggtacgctggggctgctcggcgcgaaagacgatctggcgaaagatggcatgcgagttggaggaaatagtgggccgttggaagatgttaaagtgggcgtggggcaggcggaccgagtcgcggataaagtgcgcgtaggagtcttgcagcttggcaaccagctcggcagtgacaaggacgtccatggcgcagtagtccagcgtttcgcggataatgtcataacccgtctgtcctttcttctcccacagctcgcggttaagggcgtactcctcgtcatccttccagtactcccggagcgggaatccttgatcgtccgcacggtaagagcccagcatgtagaaatggttaacggccttgtagggacagcagcccttctccacggggagggcgtaagcttgagcggccttgcggagcgaggtgtgcgtcagggcaaaggtgtccctgaccatgactttcaaaaactggtacttaaagtccgagtcgtcgcagccgccgtgttcccatagctcaaaatctgtgcgcttctttgagagggggttaggcagagcgaaagtgacgtcattgaagagaatcttgcctgctcgtggcatgaaattgcgggtgatacggaaagggcccgggacgcaggctcggttgttgataacctgggcggctaggacaatctcgtcaaagccgttgatgttgtgcccgacgatgtatagttccataaatcgcgggcggcctttgatgtgcggcagctttttaagctcctcgtaggtaaggtcctcagggcattgcaggccgtgctgctccagtgcccactcctggagatgtgggttggcttgcatgaaagaagcccagagctcgcgggccataagggtctgaagctcgtcgcgaaagaggcggaactgctggcccacggccatcttttcgggggtgatgcagtaaaaggtaagggggtcccgctcccagcgatcccagcgtaaacgcacggcaagatcgcgagcaagggcgaccagcttggggtccccggagaattttatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatccctccggcgaaccgagcactcgtgctgatgcttgtaaaagcgtccgcaatactcgcagcgctgcacgggctgtaccttatccacgagatacacagcgcgtcccttaaggaaaaacttcaggagtggcggccctggctggtggttttcatgttcgcctgcgtaggacttaccctggggctcctcgaggacggagaggctgacaagcccgcgcgggagccaggtccagatctcggcgcggcgggggcggagagcgaagacaagggcgcgcagttgggagctgtccatggtgtcgcggagatccaggtccgggggcagggttctaaggttgaccttgtagaggcgggtgagggcgtgcttgagatgcaaatggtacttgatttctacgggtgagttggtggccgtgtccacgcattgcatgagcccgtagctgcgcggggccacgaccgtgccgcggtgggtttttaaaagcggtgtcgcggacgcgctcccggcggcagcggcggttccggccccatgggcaggggcggcagaggcacgtcggcgtggcgctcgggcaggtcccggtgctgtgccctgagagcgctggcgtgcgcgacgacgcggcggttgacatcctggatctgccgcctctgcgtgaagaccacgggtcccgtgactttgaacctgaaagacagttcaacagaatcaatctcggcgtcattgacggcggcctgccgcaggatctcttgcacgtcgcccgagttgtcctggtaggcgatctcggacatgaactgctcgatctcctcctcctggagatcgccgcgacccgcacgctcgacggtagcggcaaggtcattcgagatgcggtccataagctgcgaaaaggcgcccaggccgctctcgttccagacgcggctgtacaccacgtccccgtcaacgtcgcgcgcgcgcatgaccacctgcgcaaggttaagctccacgtgccgcgtaaaaacggcgtagttgcgcaggcgctgaaaaaggtagttaagggtggtggcaatgtgctcggtaacaaaaaagtacataatccagcggcgcaggggcatttcgctgatgttgccaatggcctccagcctttccatagcctcgtagaagtccacggcgaagttgaaaaactgggcgttgcgggccgataccgtaagctcgtcttccagaagccggatgagctcggcgatggtggcgcgcacctcgcgctcaaaatccccgggggcctcctcttcttcctgttccataacgacctcttcttgtatttcttctgggggcggtggtggtggcggggcccgacgacgacggcgacgcaccgggagacggtcgacgaagcgctcgatcatctccccgcggcggcgacgcatggtttcagtgacggcgcgaccctgttcgcgaggacgcagcgtgaagacgccgccggtcatctcccggtaatagggcgggtccccgttgggtagcgaaagggcgctaacaatgcatcttattaattgcggtgtaggggacgtaagcacgtcaagatcgaccggatcggaaaatttttgaaggaaagcgtctagccaatcgcagtcacaaggtaagcttaaacacgtagcagccctgtggacactgttacaattgcgattgctaatgatgtaattgaagtaggcgtttttcaggcggcggatggtggcaagaaggaccaggtccttgggtcccgcttgctgtatgcggagccgctcggccatgccccaggcctgaccctgacaccggctgaggttcttgtagtagtcatgcatgagcctctcaatgtcatcatttgcggcggaggcggagtcttccatgcgggtgaccccgacgcccctaagcggctgcacgagcgccaggtcggcgacgacacgctcggcgaggatggcctgttgcacgcgggtgagggtgtcttggaagtcgtccatgtcaacaaagcggtggtaggccccggtgttgatggtgtaggtgcagttggccataagcgaccagttaacggtttgcaaaccgggctgcacgacctcggagtacctaagccgcgagaaggcgcgcgagtcaaagacgtagtcgttgcaggtgcgcacaaggtactgatatccgactaggaagtgcggcggcggctggcggtacagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggtaggaaataatccatggtcggcacggtctggccggtaagacgtgcgcagtcattgacgctctagaggcaaaaacgaaagcggttgagcaggctcttcctccgtagcctggcggaacgcaaacgggttaggccgcgcgtgtaccccggttcgagtcccctcgaatcaggctaaagccgcgactaacgtggtattggcactcccgtctcgacccaagcccgatagccgccaggatacggtgaagagcctttttgccggccgagtggggtcgctagatttgaaagcggttaaaaaccccgctgggtagtggctcgcgcccgtagtctggacaagcatcactagggttaagttacagcagaacccggttcgcggacggccgcggcaagcgggacttagttaccccgccaatttaaagacccgcagccagccgacttttccagttacgggagcgagcccccttttttctttttgccagatgcatcccgtcctgcgccaaatgcgtcccacccccccggcgaccaccgcaaccgcggccgtagcaggcgccggcgctgtacaacagcagacagagatggacttggaagagggcgaagggctggcgagactgggggcgccgtccccggagcaacacccccgcgtgcagctgcaaaaggacgtgcgcccggcgtacgtgcctgcgcagaacctgttcagggaccgcagtggggaggagcccgaggagatgcgcgactgccggtttcgggcgggcagggagctgcgcgagggcctggaccgccagcgcgtgctgcgcgacgatgattttgagccaaacgagcagacggggatcagccccgcgcgcgcgcacgtggcggcggccaacctggtgacggcctacgagcagacggtaaaacaggagcgcaacttccaaaagagttttaacaaccacgtgcgcaccctgatcgcgcgcgaggaggtggccctgggcctgatgcacctatgggacctggcggaggccatcgtacagaacccgaacagcaagcctctgacggcgcagctgttcctggtggtgcagcacagcagggacaacgaggcgtttagggaggcgctgctaaacattgccgagcccgagggtcgctggctgctggagctaattaacattttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtaaagatagacagcttttacatgcgcatggcgctcaaggtgctaacgctgagcgacgacctgggtgtgtaccgcaacgaccgcattcacaaggccgtgagcacaagccggcggcgcgagctaagcgaccgcgagctgatgatgagcctgcgccgggcgctggtagggggcgccgccagcggcgaagagtcctactttgacatgggggcggacctgcattggcagccgagccggcgcgccttggaggccgcctacggtccagaggacttggatgaggatgaggaagaggaggaggatgcacccgctgcggggtactgacgcctccgtaatatgtttttagatgtcccagcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactgtcggccattttggaggcggtggtcccctctcggaccaaccccacgcacgagaaggtgctggcgatcgtgaacgcgctggcggagaacaaggccattcgtcccgacgaggccgggctggtgtacaacgccctgctggagcgcgtgggccgctacaacagcacaaacgtgcagtccaacctggaccggctggtgacggacgtgcgcgaggccgtggcgcagcgcgagcggttcaagaacgagggcctgggctcgctggtggcgctaaacgccttcctggcgacgcagccggcaaacgtgccgcgcgggcaggacgattacaccaattttatcagcgcactgcggctgatggtgaccgaggtgccccagagcgaggtgtaccagtcgggcccggactactttttccagactagcagacagggcctgcagacggtaaacctgagccaggctttcaagaacctgcgcgggctgtggggcgtgcaggcgcccgtgggcgaccggtcgacggtgagcagcttgctgacgcccaactcgcggctgctgctgctgctgatcgcacccttcaccgacagcggcagcgtaaaccgcaactcgtacctgggccacctgctgacgctgtaccgcgaggccataggccaggcgcaggtggacgagcaaaccttccaggagatcacgagcgtaagccgcgcactggggcagaacgacaccgacagtctaagggccacccttaacttcttgctgaccaatagacagcagaagatcccggcgcaatatgcgctgtcggccgaggaagaaaggattctgagatatgtgcagcagagcgtagggctgttcctgatgcaggagggggccacccccagcgccgcgctggacatgaccgcgcgcaacatggaacctagcatgtacgccgccaaccggccgtttattaataagctgatggactacctgcaccgcgcggcgtccatgaactcggactactttaccaatgccatcttgaacccgcattggctcccgccgccagggttctacacgggcgagtacgacatgcccgaccccaacgatgggtttttgtgggacgacgtggacagcgcggtgttctccccaattttgcaaaagcgccaggaggcggtgcgcacgcccgcgagcgagggcgcggtgggtcggagcccctttcctagcttgggcagcttgcatagcctgcctgactcagtaaacagcggcagggtgagtcggccgcatttgctgggcgaggacgagtacctgaacgactcgctgctgcggccgccgcgggccaagaacgccatggccaataacgggatagaaagtctggtggacaaactgaaccgctggaagacctacgctcaggaccatagggaacctgcgcccgcgccgcggcgacagcgccacgaccggcagcggggcctggtgtgggacgacgaggactcggccgacgatagcagcgtgttggacttgggcgggagcggtagggttaacccgttcgcgcatctgcagcccagactggggcgacggatgttttaaatgcaaaataaaactcaccaaggccatagcgtgcgttctcttccttgttagaaatgaggcgcgcggtggtgtcctctcctcctccctcgtacgaaagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctcaactaccaaaacgaccacagcaacttcctaaccacggtggtgcagaacaacgatttcacccccgccgaggccagcacgcagacgataaattttgacgagcggtcccggtggggcggtgatctgaagaccattttgcacaccaacatgcccaatgtgaacgagtacatgttcaccagcaagtttaaggcgcgggtgatggtggctaggaagcacccacagggggtagctgaaacagatttaagtcaggataagcttgaatatgagtggtttgagtttaccctgcccgagggcaatttttccgagaccatgaccatagacctgatgaacaacgccatcttggaaaactacttgcaagtggggcggcaaaatggcgtgctggagagcgatattggagttaagtttgacagcagaaatttcaagctgggctgggacccggtgactaagctggtgatgccgggggtctacacatacgaggccttccatcccgacgtggtgctgctgccgggctgcggggtggacttcaccgagagccgcctgagcaaccttctgggcattcgcaagaagcaacctttccaagagggcttcaggattatgtatgaggatctagaagggggcaacatccccgccctgctggatgtggaagcatacctcaaaagcaagaatgatcgggaggaagccacccagaatgcaaacagagttgctgcaaatggaggtggtgaaattaggggagatacttttcttaccaccgaacagctaagagccgctgacaaggagctggttattaagcccattaaggaagatgctagcaagagaagctataatgtcataggggacacccatgacaccctgtaccgcagctggtacctgtcctatacctacggggaccccgagaagggggtacagtcgtggacgctgctcaccaccccggacgtcacctgcggcgcggagcaagtctactggtcgctgccggacctcatgcaagaccccgtcaccttccgctccacccagcaagtcagcaactaccccgtggttggcgccgagctcatgcccttccgcgccaagagcttttacaacgatctcgccgtctactcccagctcatccgcagctacacctccctcacccacgtcttcaaccgcttccccgacaaccagatcctgtgtcgcccgcccgcgcccaccatcaccaccgttagtgaaaacgtgcctgctctcacagatcacgggacgctaccgctgcgcagcagtatccgcggagtccagcgagtgaccgttactgacgcccgtcgccgcacctgtccctacgtctacaaggccctgggcatagtcgcgccgcgcgtgctctctagtcgcaccttttaaaaaatgtccattcttatctcgcccagcaataacaccggctggggtcttactaggcccagcaccatgtacggaggagccaagaagcgctccgatcagcaccccgttcgcgtccgcggccactttcgcgctccctggggcgcttacaagcgcgggcggacctctgcccccgccgccgtgcgcaccaccgtcgacgatgtcattgactcggtagtcgctgacgcgcgcaactacacccccgccccctccaccgtggacgcggtcattgacagcgtggtggctgacgcgcgcgactatgccagacgcaagagccggcggcgacgcattgccaggcgccaccggagcacgcccgccatgcgcgccgcccgggctctgctgcgccgtgccagacgcactggccgccgggccatgttgcaagccgcgcgtcgcgccgccgccgcacccacccccacaggcaggactcgcagacgagcggccgttgccgccgccgcggccatctctagcatgaccagacccaggcgcggaaacgtgtactgggtgcgcgactccatcacgggcgtgcgcgtgcccgtgcgcacccgtcctcctcgtccctgatctaatgcttgtgtcctcccccgcaagcgacaatgtcaaagcgcaaaatcaaggaggagatgctccaggtcgtcgccccggagatttacggaccaccccaggcggaccagaaaccccgcaaaatcaagcgggttaaaaaaaaggatgaggtggacaaggaggcagtagagtttgtgcgcgagtttgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtatggcgacgacgacatcctggaccaggcggcggagcgggcgggcgagttcgcctacgggaagcggtcgcgcgaagaggagctgatctcgctgccgctggacgagagcaaccccacgccgagcctgaagcccgtgaccctgcagcagatgctgccccaagcagtgctgctgccgagccgcggggttaagcgcgagggcgagaacatgtacccgaccatgcagatcatggtgcccaagcgtcggcgcgtggaggacgtgctggacaccgtgaaaatggatgtggagccccaggtcaaggtgcgccccatcaagcaggtggcgccgggcctgggcgtgcagaccgtggacattcaaatccccaccgacatggatgtcgacaaaaaaccctcgaccagcatcgaggtgcagaccgacccctggctcctagcctccaccgccgccacggccaccgagcctcccaggaggcgaagatggggccctgccaaccggttgatgcccaactacgtgttgcatccttccatcattccgacgccgggctaccgcggcacccggtattacgccagccgcaggcgccccgcaggcaagcgccgtcgccgcaccaccacccgccgccgtctggcccccgcccgcgtgcgccgcgtaactacgcgccggggccgctcgcttgttctgcccaccgtgcgctaccaccccagcatcctttaattcgtgtgctgtgatactgttgcagagagatggctctcacttgccgcctgcgcattcccgtcccgaattaccgaggaagatcccgccgcaggagaggcatggcaggcagcggcctaaaccgccgccggcggcgggccatgcgcaggcgcctaagtggcgggttcctgcctgcgcttatccccataatcgccgcggccattggcacgatcccgggcatagcttccgttgcgctgcaagcgtcgcagcgccgttaatgtgcaaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcaacgctccggacctatgggaacaaggcctggaatagtagcacagggcagatgttgagggaaaagcttgcagaccaaaacttccagcaaaaggtggtggacggcctggcctcgggcattaacggggtagtggacattgcaaaccaggccgtgcagcgcgagataaacagccgcctgaacccgcggccgcccacggtagtggagatggaagatgcaactcttccccccaggggcgagaagcggccgcggcctgacgcggaggagacaaccctgcaggtagacgagccgccctcgtacgaggaggccctcaaggccggcatgcccaccacacgcatcattgcgccaatggccacgggtgtcatgaaacccgccacccttgacctgccttcaccacccgtgcccgctccaccaaaggcagctccggttgagcaggcccccccggtggcaaccgccgtgcgccgcgttcccgcccgccgccaggcccagaactggcagagcacgctacacagtatcgtgggcctaggagtgaaaagtctgaagcgccgccgatgctattaagaaaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgtgccaccgacacgtacttcagcctgggcaacaagtttagaaaccccacggtggctcccacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacgtactttgacatccgcggcgtcctggaccgcggtcccagcttcaaaccctactcgggcacggcttacaacagcctggctcccaagggcgcccccaatcccagtcagtgggaacaggcaaaaacaggagctggtgtagaccaaaatcaaaaagaaactcgcacttacggcgtagccgccactggcggatataacattacaaaagaaggacttcagattggaattgatgaaactaaagaagatccaaacaacaaaatttatgcagataaaacattccagccggaaccacaaataggggaaaataattggcaggacactaatgttttctatggcggcagagctcttaaaaaggaaaccaagatgaaaccatgctatggctcatttgccagaccaactaataaaaaaggagggcaggctaaagttttaaccactgaagatggtcaacctacagaaaactttgacatagacttggctttctttgatattccacaagctggtggaaatgacaatcttgatccagatatgattctgtatgccgaaaatgtaaatctagaaacacctgacacacatgtagtttataaaccaggcaaggatgatgcaagttctgccgctaacctcacacaacagtccatgccaaacagacccaactacatcggtttcagggacaactttgtgggacttatgtattacaacagcactggcaacatgggtgtgctggctggtcaggcctctcagttaaatgctgtggtcgacttgcaagacagaaataccgagctgtcttatcagcttttattagattctctgggtgacaggaccagatactttagtatgtggaactctgcggtggacagctatgatccagatgtcaggatcattgagaatcacggtgtggaggacgaacttccaaattattgcttcccattggatggtaccggtaccaatgccacataccaaggtgtggaaccagataatgctcaaggtcaaaatgataaatggaaaaaggacgagaaagtggctgctcaaaaccaaatttgcaagggcaatatttatgccatggagattaacctccaggccaacctgtggaagagttttctgtactcgaacgtggccttgtacctgcccgactccttcaagtacacgccggccaacgtcacgctgcccactaacaccaacacctacgagtacatgaacgggcgcgtggcggccccctcgctggtggacgcctacgtcaacattggcgcccgctggtcactggaccccatggacaacgttaacccctttaaccaccaccgcaatgcgggcctgcgctaccgctccatgctgctgggcaacgggcgctacgtgcccttccatattcaagtgccccaaaagttttttgccattaagaacctgcttctgctcccgggctcctacacctacgagtggaacttccgcaaggatgttaacatgattctgcagagttcccttggcaacgacctgcgcgtcgacggtgcctccgtccgcttcgacagtgttaacctttacgccacctttttccccatggcgcacaacaccgcctccaccctggaagccatgctgcgcaacgacaccaacgaccagtccttcaacgactacctctcagccgccaacatgctttaccccatcccagccaaggccaccaacgtgcccatttccatcccctcgcgcaactgggccgcctttcgcggctggagtttcacccgcctaaaaaccaaggaaactccctccctcggctcgggttttgacccctactttgtttactcgggcaccatcccctacctcgacgggaccttctacctgaaccacacctttaagaaggtctccatcatgttcgactcctcggttagctggcccggcaacgacaggctgcttacgccgaacgagtttgaaattaagcgcagcgtcgacggggagggctataacgtggcccaatgcaacatgaccaaggactggttcctggtccagatgctttcccactacaacattggctaccagggcttccatgtgcctgagggctacaaggaccgcatgtactccttctttcgcaacttccagcccatgagtaggcaggtggttgatgagattaactacaaggattacaaggccgttgccctgcccttccagcacaacaactcgggcttcaccggctacctcgcacctaccttgcgccagggacagccgtaccccgccaacttcccctacccgcttatcggacagaccgccgtgccctccgttacccagaaaaagtttctctgcgacagggtcatgtggcgcatccccttctccagcaacttcatgtctatgggcgcccttaccgacctgggtcaaaacatgctttacgccaactcggcgcacgcgctcgacatgacctttgaggtggaccccatggatgagcccaccctcctgtatcttctctttgaagttttcgacgtggtcagagtgcaccagccgcaccgcggcgtcatcgaggccgtctacctgcgcacgcccttctccgccggcaacgccaccacctaagcatgagcggctccagcgaacaagagcttgcggccatcgtgcgcgacctgggctgcgggccctactttttgggcacccacgacaagcgcttcccgggcttccttgccggcaacaagctggcatgcgccatcgtcaacacggccggccgcgaaaccgggggcgtgcactggcttgcctttggctggaacccgcgctcgcgcacctgctacatgtttgacccctttgggttctcggaccgccggcttaagcagatttacagcttcgagtacgaggccatgttgcgtcgcagtgccctggccttatcgcccgaccgctgtcttagcctcgagcagtccacccagaccgtgcaggggcccgactccgccgcctgcggactcttttgttgcatgttcttgcatgcctttgtgcactggcccgatcgacccatggacgggaaccccaccatgaacttgctgacgggggtgcccaatggcatgctacaatcgccacaggtactgcccaccctccggcgcaaccaggagaagctctaccgcttccttgcgcaccactccccctactttcgctcccaccgcgccgccatcgaacacgccaccgcttttgataaaatgaaacaactgcgtgtataactcaaataaacagcacttttattttacatgcactggagtatatgcaagttatttaaaagtcaaaggggttctcgcgctcgtcgttgtgcgccgcgctgggaagggccacgttgcggtactggtacttgggctgccacttaaactcggggatcaccagtttaggaacagcaatctcggggaaggtctcgctccacatgcgccggctcatttgcagggcgcccagcatgtccggggcggagatcttaaaatcgcagttgggaccggtgctttgcgcgcgcgagttgcggtacacagggttgcagcactggaacaccatcagactggggtactttacgctggccagcacgctcttatcgctaatttgatccttgtccaggtcctcggcgttgctcaggccgaacggggtcatcttacacagctggcggcccaggaagggcacgctgtggggcttgtggttacactcgcagtgcacgggcattagcatcattcccgcaccgcgctgcatattcgggtatagggccttaacaaaggccataatctgcttaaaagcttgctgggccttagctccctcgctaaaaaacaggccgcagcttttcccgctaaactggttatttccgcacccggcatcttgcacgcagcagcgcgcgtcatggctggtcagttgcaccacgcttctcccccagcggttctgggtcactttggccttgctgggttgctccttcaacgcgcgctgaccgttctcgctggtcacatccatctccaccacatggtccttgtggatcattaccgtcccgtgcagacacttaagctggccttccacctcggcacagccgtggtcccacagggcactgccggtgcactcccagtttttgtgcgcgatcccgctgtggctaaagatgtaaccttgcaacaggcgacccatcacggtgctaaagctcttctgggtggtaaaggtcagttgcatcccgcgggcctcctcgttcatccaggtctggcacattttttggaatatctcggtctgctccggcataagcttgtaagcattgcgcaggccgctgtcgacgcggtagcgttccatgagcacgtttatggtatccatgcccttctcccaggacgaaaccaaaggcagactcagggggttgcgcacgttcaaaataccaggggtcgcgggctcgacaatgcgttttccgtccttgccttccttcaacagaaccggcggctggctgaatcccactcccacgatcacggcatcttcctggggcatctcttcgtcggggtttaccttggtcacatgtttggtctttctgggctgcttcttttttggagggctgtccactggaaccacgtcctcctcggaagacccggagcccacccgctgatactttcggcgcttggtgggcagaggaggtagcggcggcgaggggctcctttcctgctccggcggatagcgcgccgacccgtggccccggggcggagtggcctctcggtccataaaccggcgcacgtcctgactgccgccggccattgtttcctaggggaagatggaggagcagccgcgtaagcaggagcaggaggaggagaacttaaccacccacgagcaacccaaaattgagcaggacctgggcttggaagagccggctcgtctagaacccccacacgatgaacaggagaagaccaacgctgggctggagcatggctacctaggaggacaggaggatgtgctgctaaaacacttgcagcgccagtcctttatcctccgggacgctctggccgaccgaagcaaaacccccctcagcgtccaggagctgtgtcgggcctacgagctcaacctcttctcgccgcgcgtgccccccaaacgccagcccaacggcacctgcgagcccaacccgcgtcttaacttctaccccgtctttgcggtccccgaggcccttgccacttatcacatattttttaaaaaccaaaaaatccccgtttcctgccgcgccaaccgcacccgcgccgacgcactcctcgctctggggcccggcgcgcgcatacctgatatcgcttccctggaagaggtgcccaagatctttgaagggcttggtcgggacgagacgcgcgcggcgaacgctctaaaagaaacagcagaggaaaagggttacactagcgccctggtagagttggaaggcgataacgccaggctggccgtgcttaagcgcagcgtcgagcttacccatttcgcctaccctgccgttaacctcccgcccaaggtcatgcgtcgcatcatggatcagcttatcacgccccacattgaggcccttgatgaaagccaaaagcagcgccctgaggacgcccggcccgtggtcagcgacgaaatgcttgcgcgctggctcggaaaccgcgacccccagtccctggagcagcggcgtaagctcatgctggccgtggtcctggtcaccctcgagttggaatgcatgcgccgcttttttagcgaccccgaaaccctgcgcaaggttgaagagaccctgcactacactttcaggcacggctttgtcaggcaggcctgcaagatctctaacgtggagctaaccaacctggtctcctgcctgggtattttacacgagaaccgcctggggcagaccgtgcttcactcgaccctgaagggcgaggcgcggcgggactacatccgcgactgtgtctttctttttctttgccatacctggcagtcggccatgggcgtgtggcagcagtgtctccaggacgagaacctgaaggagctggacaagcttcttgctaaaaaccttaaaaagttatggacgggctttgacgagcgcaccgtcgcctcggacctggccgagattgtttttcctgaacgcctgaggcagacgcttaaaggcgggctgcccgactttatgagccagagcatgttgcaaaactaccgcactttcattctcgagcgatcgggaatcctgcccgccacctgcaacgccttcccctccgactttgtcccgctgagctaccgccagtgtcccccgccgctgtggagccactgctacctcttgcagctggccaactacatcgcccaccactcggacgtgatcgaggacgtaagcggcgaggggctgcttgagtgccactgccgctgcaacctgtgctccccgcaccgctccctggtctgcaacccccagctcctaagcgagacccaggtcatcggtacctttgagctgcaaggtccggaaaactccaccactccgctgaaacttacgccggggttgtggacttccgcgtacctgcgcaaatttgtaccccaggactaccacgcccacgagataaagttctttgaggaccaattgtgcccacagcacgcggatcttacggcctgcgtcatcacccagggcgcaatcctcgcccaattgcacgccatccaaaaatcccgccaagagtttcttctaaaaaagggtaaaggggtttacctggacccccagacaggcgaagtgcttaacccgggtcttccccagcatgccgaggaagaagcaggagccactagtggaggagatggaagaagaatgggacagccaggcagaggaggacgaatgggaggaggaggaggaagaattggaagaggtgcaacaggagcaggcaacagagcagcccgtcgccgcaccatccgcgccggcagcccctccggtcaagcctcctcgtagatgggatcaagtgaagggtgacggtaagcaccagcggcagggctaccgatcatggagggcccacaaagccgcgatcattgcctgcttgcaagactgcggggggaacattgcttttgcccgccgctacctgcttttccaccgcggggtaaacatcccccgcaacgtgttgcattactaccgtcaccttcacagctaacaaaaagcaagtaagaggagtcgccggaagaggaggcctcaggattgcggcggacgagcccttcaccaccagggagctaagaaaccgaatattccccactctttatgccatttttcagcagagtcgaggtcagcagcaagagcttaaagtaaaaaatcggtctctgcgctcgctcacccgcagttgcttgtaccacaaaaacgaagatcagctgcagcgcactcttgaagacgccgaggctttgtttcacaagtactgcgcgctcactcttaaagactaaggcgcgcccacccgaaaaaaaggcgggaattacctcatcgccagcaccatgagcaaggagattcccacgccttacatgtggagctatcagccccagatgggcctagccgcgggcgcctcccaggactactccacccgcatgaactggctcagtgccgggccctcaatgatctcacaggtcaacgggatccgtaaccatcgaaaccagatattgttggagcaggcggcagtcacctccacgcccagggcaaagcttaacccgcgtaattggccctccaccctggtgtaccaggaaattcccgggccaactaccgtactacttccgcgtgacgcactggccgaagtccgcatgactaactcaggtgtccagctggccggcggcgcttcccggtgcccgctccgcccacaatcgggtataaaaaccctggtgatccgaggcaaaggcacacagcttaacgacgagttggtaagctctgcaatcggtctgcgacctgatggagtgtttcaactagccggagccgggaaatcgtcctttactcccaaccaggcctacctgaccttgcagagcagctcttcggagcctcgctccggaggcattggaaccctccagtttgtgcaggagtttgtgccctcggtctactttaaccccttctcgggatcgccaggcctttacccggacgagtttataccgaactttgacgcagtgagagaagcggtggacggctacgactaaatgtcctatggtgactcggctgagcttgctcggttaaggcatctggaccactgccgccgcctgcactgctttgcccgggagagctgcgggcttatctactttgagcttcccaaggagcaccccaacggccctgcacacggagtgcggattaccgtagagggcaccaccgagtctcacctggttaggttcttcacccagcaacccttcctggtcgagcgggaccgggctgcaaccacctacaccgtgtactgcatttgtccaaccccgaagttgcatgaaaatttttgctgtactctttgtggtgagtttaataaaagctgaaataagactctactctggaatccagtgtcgtcataatcgcaccgagaccattaactttaccacccaggaacaggtgaactttacctgcaaactccacaagaagtacctcatatggtttttcaacaacactactcttgcagtagttaacacctgtgacaacgacggtgttcttcttcccaacaatctcaccagtggactagccttctctgttaaaagggcaaagctaattcttcattgccctataactgatttaagcccaaaaaccaatcaaacccccttttcccatctacccaaataaacatttattggaaataattattcaataaagatcacttacttaaaatctgaaagtatgtctttggtgtagttgtttagcagcacctcagtcccctcctcccagctctggtactccagtccccggcgggcggcaaactttctccacaccttgaaagggatgtcaaattcctggtccacaattttcattgtcttccctcttagatgacaaagagactccgggtggaagatgacttcaaccccgtctacccctatggctacgcgcggaatcaaaatattcccttcctcactcccccctttgtctcctccaatggatttcaaaacttcccccctggggtcctgtcacttaaactggctgacccaatcaccattaacaatcaaaatgtatcactcaaggttggaggggggctaactttgcaagaagaaactggaaaattaacagttaatactgaaccacctttgcatcttacaaataacaaattagggatagctttagacgctccatttgatgttatagacaataagcttacactattagcaggccatggcttgtctattataacaaaagaaacatcaacactgcctggcttggttaatactcttgtagtattaactggaaagggtattggaacagatttatcaaataatggtggaaatatatgtgttagagttggagaaggcggcggcttatcatttaatgacaatggagacttggtagcatttaataaaaaagaagacaaacgcaccctatggacaactccagacacatctccaaattgcagaattgatcaggataaggactctaagctaactttggtccttacaaagtgtggaagtcaaatattagccaatgtgtcattaattgttgtagctggaaggtacaaaattatcaataacaatactaatccagctcttaaaggatttaccattaaattgttgtttgataaaaatggagtccttatggaatcttcaaatcttggtaaatcatattggaactttcgaaatcaaaattcaattatgtcaacagcttatgaaaaagctattggttttatgcctaatttggtagcctatccaaaacctaccactggctctaaaaaatatgcaagagatatagtttatggaaacatctaccttggcggaaagccacatcaaccagtaaccattaaaactacctttaaccaggaaactggatgtgaatactctattacatttgattttagttgggccaaaacttatgtaaatgttgaatttgaaactacctcttttaccttttcctatattgcccaagaataaaggataaataaacgtgtttttcatttaaaaatttcatgtatctttattgatttttacaccagcgcgggtacacattctcccaccaccagcccattttacagtgtaaacaattctctcagcacgggtggccttaaataggggaaagttctcattagtgcgggaactggacttggggtttataatccacacagtttcctggcgagccaaacgggggtcggtgattgagatgaagccgtcctttgaaaaatcatccaagtgggcctcgcagtccaaggtcacagtctggtggaatgagaagaacgcacagactcatactcggaaaacaaaatgggtctgtgcctctccatcagcgcccttaacagtctctgccgccggggctcggtgcggctgctacagatgggatcgggatcgcaagtctctttcactataatccccacagcctttagcattagtcttctggtgcgtcgggcacagcaccgcatcctaatctcgctcatgttttcacagtaagtgcagcacataatgaccatgttattcagcagcccataatttagggtgctccagccaaagcttatgttggaaatgatggaacccacgtgaccatcgtaccaaatgcggcagtatatcaggtgcctgccccttataaacacactgcccatatacataatctctttggacatgtttctatttacaatctgccggtaccaggggaagcgctggttgaacatgcacccgtaaatgactctcctaaaccacacggccagcagggtgcctcccgcccggcactgcagggagcccggggataaacagtggcaatgcaggatccagcgctcgtacccgcttaccatctgggctcttaccagatccagggtagcgggacacaggcacactgacatacatctttttaaaatttttatttcctttcgggtcaggatcatatcccaggggactggaaactcttggagcagggtaaaaccagcagcacatggtaatccacggacagaacttacattatgataatctgcatgatcacaatcgggcaatacagggtgttgttcagtcaaagaggccctggtctccttatcatatcgtggtaaacgggccctgcgatatggataatggcggagcaaggttgattgttccttggtgctcattgtagcgcaccctcttgcgtacctcgttgtacttttgccagcagaaagtggccctggaacagcaaatacctctcctccgaccgtcctttcgctgttgccgctcagtcatccaactgaagtacatccattcccaaaggttgtgaagaagttcctttgtatctaatgaaacaaaaagcccgtccatgcggattcccctcatcacatcagccaggactctgtaggccatccccatccagttaatgctgccttgtctatcatttaaagggggcggtggcaaaattggaagaaccatttttattccaaacggtctcgaaggacgataaagtgcaagtcacgcaggtgacagcgttcaccgccgctgtgttggtggaaacatacagccaggtcaaaacccactctattttcaaggtgctcgactgtggcttcgagcagtggctctacgcgtacatccagcataagaatcacattaaaagccggccctccatcgatttcatcaatcatcatgttacattcctgcaccatccccaggtaattctcatttttccagccttggattatttctacaaattgttggtgtaagtccactccgcacatgtggaaaagctcccatagcgccccctccactttcataatcaggcagaccttcataatagaaacaaatcctgctgctccaccacctgcagcgtgtttaaaacaacaacatttaataaggttctgccctcagcccttagctgacgtctaagtgtcagctgcaaaaagtcacttaagtcctgggccactacagctgacaattcagagccagggctaagcgtgggactggcaagcgtaagggagtactttaatgctccaaagctagcacctaaaaactgcatgctggaataagctctttttgtatctccggtaatgccttccaaaatgtgagtaataaagcgaggtagtttttctttaatcatgttagtaatagaaaaatcctctaaatacgtcactaggaccccagggaccacaatgtggtagcttacaccgcgtcgctgaagcatggttagtagagatgaaagtctgaaaaacaaaaagcatgcgctaaaccaaggtggctatttttactgaaggaaaaattactttttttagcagcagggtgcccactgggtggcccttgcggacatacaaaaattggtccgtgtgattaaaaagcagtacagcaagctcctgtcttctcccggcaaaaatcacatcggactgggttagtatgcccctggcatggtagtcatttaaagccataaatgtgccctgataaccagtaggaacgagtacactgacttttaggtaaaccaataccaccccatgcggaaaaatataaaaagattcaggacaaaaaaaggtatatttattgctagccccttcctggacgggagccatccctccagggctatctataaaagcatagagacattcagccatagcttagcccgcttaccagtagacaaagagcacagcagtacaagcgccaacagcaataactacttactgtgccagctcagtacttaaaggcagcttacactgacgtaatgaccaaaggtgtaaaaaccccgccaaaaaaaaacacacacgccctaggtgtttttcgtaaaaacacttccgcgttctcacttcctcgtatcaattttgtgacttaacttccgggttcccacgttacgtcacttttgcccttacatgtgactgtgccatagggcgccattttcccgtgcccaatatggctaaagtccgcttttttatacgtcatcggccccgcgacttgcttccgggttgggccacgcctttgcggcaaccgccggccgtacgtcttgacgtcaactgcattaccgcttgttaaccacttaacgttggccctgccctaaaaccgttaaaatttaaaagctcatttgcatattaacttttgtttactttgtggggtatattattgatgatg

SEQ ID NO: 1415 - DNA, 37177 bp, Adenovirus D17
  MISC_FEATURE (1)..(37177): Adenovirus D17 variant
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaacatatgcatcatcaataatataccccacaaagtaaacaaaagttaatatgcaaatgaggttttaaatttagggcggggctactgctgattggccgagaaacgttgatgcaaatgacgtcacgacgcacggctaacggtcgccgcggaggcgtggcctagcccggaagcaagtcgcggggctgatgacgtataaaaaagcggactttaaacccggaaacggccgattttcccgcggccacgcccggatatgaggtaattctgggcggatgcaagtgaaattaggtcattttggcgcgaaaactgaatgaggaagtgaaaagtgaaaaataccggtcccgcccagggcggaatatttaccgagggccgagagactttgaccgattacgtgtgggtttcgattgcggtgttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtgtgagaaaaatgagacacctgcgcctcctgcctggaactgtgcccttggacatggccgcattattgctggatgactttgtgagtacagtattggaggatgaactgcaaccaactccgttcgagctgggacccacacttcaggacctctatgatttggaggtagatgcccaggaggacgacccgaacgaagatgctgtgaatttaatatttccagaatctctgattcttcaggctgacatagccagcgaagctctacctactccacttcatactccaactctgtcacccatacctgaattggaagaggaggacgagttagacctccggtgttatgaggaaggttttcctcccagcgattcagaggacgaacagggtgagcagagcatggctctaatctcagactatgcttgtgtggttgtggaagagcattttgtgttggacaatcctgaggtgcccgggcaaggctgtaaatcctgccagtaccaccgggataagaccggagacacgaacgcctcctgtgctctgtgttacatgaaaaagaacttcagctttatttacagtaagtggagtgaatgtgagagaggctgagtgcttaagacataactgggtgatgcttcaacagctgtgctaagtgtggtttattttgtttctaggtccggtgtcagaggatgagtcatcaccctcagaagaagaccacccgtgtccccctgagctgtcaggcgaaacgcccctgcaagtgcacagacccaccccagtcagacccagtggcgagaggcgagcagctgttgaaaaaattgaggacttgttacatgacatgggtggggatgaacctttggacctgagcttgaaacgtcccaggaactaggcgcagctgcgcttagtcatgtgtaaataaagttgtacaataaaaattatatgtgacgcatgcaaggtgtggtttatgactcatgggcggggcttagttctatataagtggcaacacctgggcactggagcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaaaaaggattataacgaggaatttgaaaatctttttgctgattgctctggcctgctagattctctgaatctcggccaccagtcccttttccaggaaagggtactccacagccttgatttttccagcccagggcgcactacagccggggttgcttttgtggtttttctggttgacaaatggagccagaacacccaactgagcaggggctacattctggacttcgcagccatgcacctgtggagggcatgggtcaggcagcggggacagagaatcttgaactactggcttctacagccagcagctccgggtcttcttcgtctacacagacaaacatccatgttggaggaagaaatgaggcaggccatggacgagaacccgaggagcggtctggaccctccgtcggaagaggagttggattgaatcaggtatccagcctgtacccagagcttagcaaggtgctgacatccatggccaggggagtgaagagggagaggagcgatgggggcaataccgggatgatgaccgagctgacggccagtctgatgaatcgcaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcattgataccctggacaaggccgcctttaggtgttgcatgatgggaatgagagccggagtgatgaatatgaattccatgatctttatgaacatgaagttcaatggagagaagtttaatggggtgctgttcatggccaacagccacatgaccctgcatggctgcgactttttcggctttaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgaggcactgctcttccctggagacgggctgcttctgcctggtgaagggcacagcctctctgaagcataatatggtgaagggctgcacggatgagcgcatgtacaacatgctgacctgcgactcgggggtctgtcatatcctgaagaacatccatgtgacctcccaccccagaaagaagtggccagtgtttgagaataacatgctgatcaagtgccacatgcacctgggcgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaaggtgactataaaggcgggtgtcttacgagggtctttttgcttttctgcagacatcatgaacgggaccggcggggccttcgaaggggggctttttagcccttatttgacaacccgcctgccaggatgggccggagttcgtcagaatgtgatgggatcgacggtggacgggcgcccagtgcttccagcaaattcctcgaccatgacctacgcgaccgtggggaactcgtcgcttgacagcaccgccgcagccgcggcagccgcagccgccatgacagcgacgagactggcctcgagctacatgcccagcagcagcagtagcccctctgtgcccagttccatcatcgccgaggagaaactgctggccctgctggccgagctggaagccctgagccgccagctggccgccctgacccagcaggtgtccgagctccgcgaacagcagcagcaaaataaatgattcaataaacacatattctgattcaaacagcaaagcatctttattatttattttttcgcgcgcggtaggccctggtccacctctcccgatcattgagagtgcggtggattttttccaagacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaagcggttgagctgggagggatgcatgcggggggagatgatgtgcagtttggcctggatcttgaggttggcgatgttgccacccagatcccgccgggggttcatgttgtgcaggaccaccaggacggtgtagcccgtgcacttggggaacttatcatgcaacttggaagggaatgcgtggaagaatttggagacgcccttgtgcccgcccaggttttccatgcactcatccatgatgatggcgatgggcccgtgggctgcggctttggcaaagacgtttctggggtcagagacatcataattatgctcctgggtgagatcatcataagacattttaatgaattttgggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctaacttggaggttttcccggacgagctcgccgaggaggcggtccccgcccagcgagaggagctcttgcagggaagcaaagtttttcaggggcttgagtccgtcggccatgggcatcttggcgagggtctgcgagaggagttcgagacggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggcccctggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgtccgcaggcgggacagaggagggattgcagggcgtagagcttgggcgcaagaaagaccgactcgggagcaaaagcgtccgctccgcagtgggcgcagacggtctcgcactcgacgagccaggtgagctcgggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccaggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcaatgctttttaggagactttcatccatctggtcagaaaagactatttttttattgtcaagcttggtggcaaaggagccatagagggcgttggagagaagcttggcgatggatctcatggtctgatttttgtcacggtcggcgcgctccttggccgcgatgttgagctggacatattcgcgcgcgacacacttccattcgggaaagacggtggtgcgctcgtcgggcacgatcctgacgcgccagccgcggttatgcagggtgaccaggtccacgctggtggccacctcgccgcgcaggggctcgttagtccagcagagtctgccgcccttgcgcgagcagaacgggggcagcacatcaagcagatgctcgtcaggggggtccgcatcgatggtgaagatgccgggacagagtttcttgtcaaaatagtctatttttgaggatgcatcatccaaggccatctgccactcgcgggcggccattgctcgctcgtaggggttgaggggcggaccccagggcatgggatgcgtgagggcggaggcgtacatgccgcaaatgtcgtagacatagatgggctccgagaggatgccgatgtaggtgggataacagcgccccccgcggatgctggcgcgcacgtagtcatacaactcgtgcgagggggccaagaaggcggggccgagattggtgcgctggggctgctcggcgcggaagacaatctggcgaaagatggcgtgcgagttggaggagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttcgcggatgatgtcataacccgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgtgcggccttgcggagcgaggtgtgcgtcagggcgaaggtgtccctgaccatgactttcaagaactggtacttgaaatccgagtcgtcgcagccgccgtgctcccatagctcgaaatcggtgcgcttcttcgagagggggttaggcagagcgaaagtgacgtcattgaagagaatcttgcctgctcgcggcatgaaattgcgggtgatgcggaaagggcccgggacggaggctcggttgttgatgacctgggcggcgaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccattcctggagatgtgggttggcttgcatgaaggaagcccagagctcgcgggccatgagggtctggagctcgtcgcgaaagaggcggaactgctggcccacggccatcttttcgggtgtgacgcagtagaaggtgagggggtcccgctcccagcgatcccagcgtaagcgcgcggctagatcgcgagcaagggcgaccagctctgggtcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgttgcgccctgagagcgctggcgtgcgcgacgacgcggcggttgacatcctggatctgccgcctctgcgtgaagaccactggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcgacccgcgcgctccacggtggcggcgaggtcattcgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcgttgcgggccgagaccgtgagctcgtcttccaggagcctgatgagctcggcgatggtggcgcgcacctcgcgctcgaaatccccgggggcctcgtcctcttcctcttcttccatgacaacctcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctaatgatgtaattgaagtaggcgtttttgaggcggcggatggtggcgaggaggaccaggtccttgggtcccgcttgctggatgcggagccgctcggccatgccccaggcctggccctgacaccggcttaggttcttgtagtagtcatgcatgagcctctcgatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaagtgcagttggccatgagcgaccagttgacggtctgcaggccgggctgcacgacctcggagtacctgagccgcgagaaggcgcgcgagtcgaagacgtagtcgttgcaggtgcgcacaaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcagcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgcgtgtaccccggttcgagtcccctcgaatcaggctggagccgcgactaacgtggtattggcactcccgtctcgacccgagcccgatagccgccaggatacggcggagagccctttttgccggccgaggggagtcgctagacttgaaagcggccgaaaaccccgccgggtagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccttccccggagcgacacccccgcgtgcagctgcagaaggacgtgcgcccggcgtacgtgcctgcgcaaaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccatgtgcgcaccctgatcgcgcgcgaggaggtggccctgggcctgatgcacctgtgggacctggcggaggccatcgtgcagaacccggacagcaagcctctgacggcgcagctgttcctggtggtacagcacagcagggacaacgaggcgttcagggaggcgctgctaaacatcgccgagcccgagggtcgctggctgctggagctgatcaacatcttgcagagcatcgtagttcaggagcgcagcctgagcttggccgagaaggtggcggcaatcaactactcggtgcttagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcgcgagccggcggcgcgagctgagcgaccgcgagctgatgctgagcctgcgccgggcgctggtagggggcgccgccggcggcgaggagtcctacttcgacatgggggcggacctgcattggcagccgagccggcgcgccttggaggccgcctacggtccagaggacttggatgaggaagaggaagaggaggaggatgcacccgctgcggggtactgacgcctccgtgatgtgtttttagatgcagcaagccccggaccccgccataagggcggcgctgcaaagccagccgtccggtctagcatcggacgactgggaggctgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctagtgtacaacgccctgctggagcgcgtaggccgctacaacagcacaaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggatgattacaccaactttatcagcgcgctgcggctgatggtgaccgaggtgccccagagcgaggtgtaccagtcgggcccggactactttttccaaactagcagacagggcctgcaaacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagtggcagcgtaaaccgcaactcgtacctgggtcacctgctaacgctgtaccgcgaggccataggccaggcgcaggtggacgagcagaccttccaggagatcactagcgtgagccgcgcgctggggcagaacgacaccgacagtctgagggccaccctgaacttcttgctgaccaatagacagcagaagatcccggcgcagtacgcgctgtcggccgaggaggagcgcatcctgagatatgtgcagcagagcgtagggcttttcctgatgcaggagggggccactcccagcgccgcgctggacatgaccgcgcgcaacatggaacctagcatgtacgccgccaaccggccgtttatcaataagctaatggactacctgcatcgcgcggcgtccatgaactcggactactttaccaatgccattttgaacccgcactggcttccgccgccggggttctatacgggcgagtacgacatgcccgaccccaacgacgggtttttgtgggacgacgtggacagcgcggtgttttcaccgaccttgcaaaagcgccaggaggcggtgcgcacgcccgcgagcgagggcgcggtgggtcggagcccctttcctagcttagggagtttgcatagcttgccgggctctgtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggagcctgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgttgtacgacaccactcgcgtgtacttggtggacaacaagtcggcggacatcgcttccctgaactatcaaaacgaccacagcaacttcctgaccacggtggtgcagaacaacgatttcacccccgccgaggctagcacgcagacgataaattttgacgagcggtcgcggtggggcggtgatctgaagaccattctgcacaccaacatgcccaatgtgaacgagtacatgttcaccagcaagtttaaggcgcgggtgatggtggctagaaaacacccacagggggtagaagcaacagatttaagcaaggatatcttagagtatgagtggtttgagtttaccctgcccgagggcaacttttccgagaccatgaccatagacctgatgaacaacgccatcttggaaaactacttgcaagtggggcggcaaaatggcgtgctggagagcgatattggagtcaagtttgacagcagaaatttcaagctgggctgggaccctgtgaccaagctggtgatgccaggggtctacacctacgaggcctttcacccggacgtggtgctgctgccgggctgcggggtggacttcacagagagccgcctgagcaacctcctgggcattcgcaagaagcaacctttccaagagggcttcagaatcatgtatgaggatctagaagggggcaacatccccgccctgctggatgtgcccaagtacttggaaagcaagaagaagttagaggaggcattggagaatgctgctaaagctaatggtcctgcaagaggagacagtagcgtctcaagagaggttgaaaaggcagctgaaaaagaacttgttattgagcccatcaagcaagatgatagcaagagaagttacaacctcatcgagggaaccatggacacgctgtaccgcagctggtacctgtcctatacctacggggaccctgagaagggggtgcagtcgtggacgctgctcaccaccccggacgtcacctgcggcgcggagcaagtctactggtcgctgccggacctcatgcaagaccccgtcaccttccgttctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgtccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgtgtgctttccagtcgcaccttctaaaaaatgtctattctcatctcgcccagcaataacaccggctggggtattactaggcccagcagcatgtacggaggagccaagaaacgctcccagcagcaccccgtccgcgtccgcggccacttccgcgctccctggggcgcttacaagcgcgggcggactgccaccgccgccgccgtgcgcaccaccgtcgacgacgtcatcgactcggtggtcgccgacgcgcgcaactatactcccgccccctcgaccgtggacgcggtcattgacagcgtggtggccgacgcgcgcgactatgccagacgcaagagccggcggcgacggatcgccaggcgccatcggagcacgcccgccatgcgcgccgcccgagctctgctgcgccgcgccagacgcacgggccgccgggccatgatgcgagccgcgcgccgcgccgccactgcaccccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcagagcgggcgggcgagtttgcctacgggaagcggtcgcgcgaagaggagctgatctcgctgccgctggacgagagcaatcccacgccgagcctgaagcccgtgaccctgcagcaggtgctgccccaggcggtgctgctgccgagccgcgggatcaagcgcgagggcgagaacatgtacccgaccatgcagatcatggtgcccaagcgccggcgcgtggaggaagtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgcttccacttctaccgtcgccacggtcaccgagcctcccaggaggcgaagatggggccccgccaaccggctgatgcccaactacgtgttgcatccttccattatcccgacgccgggctaccgcggcacccggtactacgccagccgcaggcgcccagccagcaaacgccgccgccgcaccgccacccgccgccgtctgccccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgttccgaattaccgaggaagatcccgccgcaggagaggcatggcaggcagcggcctgaaccgccgccggcggcgggccatgcgcaggcgcctgagtggcggctttctgcccgcgctcatccccataatcgcggcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacggcctggcctcgggcattaacggggtggtggacatcgcgaaccaggcagtgcagcgcgagataaacagccgtctggacccgcggccgcccacggtggtggagatggaagatgcaactcttccgccgccgaagggcgagaagcggccgcggccagatgcggaggagacgatcctgcaggtggacgagccgccctcgtacgaggaggccgtgaaggccggcatgcccaccacgcgcatcatcgcgccactggccacgggtgtaatgaaacccgccacccttgacctgcctccaccacccacgcccgctccaccgaaggcagctccggttgtgcagccccctccggtggcgaccgccgtgcgccgcgtccccgcccgccgccaggcccagaactggcagagcacgctgcacagtattgtgggcctgggagtgaaaagtctgaagcgccgccgatgctattgagagagaggaaggaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacgtactttgacatccgcggcgtcctggaccgcggtcccagtttcaaaccctactcgggcacggcttacaacagccttgcccccaagggcgctcccaatcccagtcagtgggttgccaaagaaaatggtcagggaactgataagacacatacttatggctcagctgccatgggaggaagcaacatcaccattgaaggtttagtaattggaactgatgaaaaagctgaggatggcaaaaaagatatttttgcaaataaactttatcagccagaacctcaagtaggtgaagaaaactggcaagagtctgaagccttctatggaggcagagctcttaagaaagacacaaaaatgaagccctgctatggctcatttgcaagacctaccaatgaaaaaggcggacaagctaaatttaagccagtggaagaggggcagcaacctaaagattatgacatagatttggctttctttgacacacctggaggcaccatcacaggaggcacagacgaagaatataaagcagacattgtgttgtacactgaaaatgtcaaccttgaaaccccagacacccacgtggtatacaagccaggaaaagaggatgacagttcagaagtaaatttgacacagcagtccatgcccaacaggcctaactacattggcttcagagacaactttgtgggactcatgtactacaacagtactggcaacatgggtgtgctggctggtcaggcctctcaattgaatgctgtggtcgacttgcaagacagaaacaccgagctgtcttaccagctcttgctagattctctgggtgacagaaccagatacttcagcatgtggaactctgcggtggatagctatgatccagatgtcaggatcattgaaaatcatggtgtggaagatgaacttccaaactattgcttcccattgaatggcactggcaccaattcaacatatcttggcgtaaaggtgaaaccagatcaagatggtgatgttgaaagcgagtgggataaagatgataccattgcaaggcagaatcaaatcgccaagggcaacgtctttgccatggagatcaacctccaggccaacctgtggaagagttttctgtactcgaacgtggccttgtacctgcccgactcctacaagtacacgccggccaatgttacgctgcccgccaacaccaacacctacgagtacatgaacggccgcgtggtagccccctcgctggtggacgcctacatcaacataggcgcccgatggtcgctggaccccatggacaacgtcaaccccttcaaccaccaccgcaatgcgggcctgcgctaccgctccatgcttctgggcaacggccgctacgtgcccttccacatccaagtgccccaaaagttctttgccatcaagaacctgctcctgctcccgggctcctacacctacgagtggaacttccgcaaggatgtcaacatgatcctgcagagttccctcggcaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgcttttcgcggctggagtttcacccgtctgaaaaccaaggaaactccctccctcggctcgggttttgacccctactttgtctactcgggctcgatcccctaccttgacgggaccttttaccttaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcacccaccatgcgccaagggcagccctaccccgccaacttcccctacccgctcatcggccagacagccgtgccatccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggaaacgccaccacctaagcatgagcggctccagcgaaagagagctcgcgtccatcgtgcgcgacctgggctgcgggccctactttttgggcacccacgacaagcgattcccgggctttcttgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgaagcgccctggcctcctcgcccgaccgctgtctcagcctcgaacagtccacccagaccgtgcaggggcccgactccgccgcctgcggacttttctgttgcatgttcttgcatgccttcgtgcactggcccgaccgacccatggacgggaaccccaccatgaacttgctgacgggggtgcccaacggcatgctacaatcgccacaggtgctgcccaccctcaggcgcaaccaggaggagctctatcgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcatcgttgtgcgccgcgctggggagggccacgttgcggtactggtacttgggctgccacttgaactcggggatcaccagtttgggcactggggtctcggggaaggtctcgctccacatacgccggctcatctgcagggcgcccagcatgtccggggcggatatcttgaaatcgcagttgggaccggtgctctgcgcgcgcgagttgcggtacacggggttgcagcactggaacaccatcagactggggtactttacgctggccagcacgctcttgtcgctgatctgatccttgtccagatcctcggcgttgctcaggccgaatggggtcatcttgcacagttggcgacccaggaatggcacgctctgaggcttgtggttacactcgcagtgcacgggcatcagcatcatccccgcgccgcgctgcatattcgggtagagggccttgacaaaggccgtgatctgcttgaaagcttgttgggccttggccccctcgctgaaaaacaggccgcagctcttcccgctgaactggttattcccgcacccggcatcctgcacgcagcagcgcgcgtcatggctggtcagttgcaccacgcttcttccccagcggttctgggtcaccttggctttgctgggttgctccttcaacgcgcgctgcccgttctcgctggtcacatccatctccaccacgtggtccttgtggatcatcaccgttccatgcagacacttgagctggccttccacctcggtgcagccgtgatcccacagggcactgccggtgcactcccagttcttgtgcgcgatcccgctgtggctgaagatgtaaccttgcaagaggcgacccatgatggtgctaaagctcttctgggtggtgaaggttagttgcagaccgcgggcctcctcgttcatccaggtctggcacatcttttggaagatctcggtctgctcgggcatgagcttgtaagcatcgcgcaggccgctgtcgacgcggtaacgttccatcagcacgttcatggtatccatgcccttttcccaggacgagaccagaggcagactcagggggttgcgcacgttcaggacaccgggggtcgcgggctcgacgatacgttttccgtccttgccttccttcaacagaaccggaggctggctgaatcccactcccacaatcacggcatcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggcggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggcccttgccacctatcacatctttttcaagaaccaaaagatccccgtctcctgccgcgccaaccgcacccgcgccgacgcgctcctcgctctggggcccggcgcgcgcatacctgatattgcttccctggaagaggtgcccaaaatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgttgagctcacccacttcgcctaccccgccgtcaacctcccgcccaaggtcatgcgtcgcatcatggatcagctaatcatgccccacatcgaggccctcgatgaaagtcaggagcagcgccccgaggacacccggcccgtggtcagcgatgagcagcttgcgcgctggcttggtacccgcgacccccaggccctggagcagcggcgcaagctcatgctggccgtggtcctggtcaccctcgagctcgaatgcatgcgacgctttttcagcgaccccgagaccctgcgcaaggtcgaggagaccctgcactacacttttaggcacggtttcgtcaggcaggcatgcaagatctccaacgtggagctgaccaacctggtctcctgcctgggaatcctgcacgagaaccgcctggggcagacagtgctccactcgaccctgaagggcgaggcgcggcgggactatgtccgcgactgcgtctttctctttctctgccacacatggcaagctgccatgggcgtgtggcagcagtgtctcgaggacgagaacctgaaggagctggacaagcttcttgctagaaacctcaaaaagctgtggacgggctttgacgagcgcaccgtcgcctcggacctggccgagatcgtcctccccgagcgcctgaggcagacgctgaaaggcgggctgcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacatcgcctaccactcggatgttatcgaggacgtgagcggcgaggggctgctagagtgccactgccgctgcaacctgtgctctccgcaccgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgcccgcagcacgcggatctcacggcctgcgtcatcacccagggcgcgatcctcgcccaattgcacgccatccaaaaatcccgccaagagtttcttttgaaaaagggtagaggggtctatctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgcagctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctatctgctcttccatcgcggggtgaacatcccccgcaacgtgttgcattactaccgtcaccttcacagctaagaaaaaatcagaagtaagaggagtcgccggaggaggcctgaggatcgcggcgaacgagcccttgaccaccagggagctgaggaatcggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggctcagtgccggcccctcgatgatctcacgggtcaacggggtccgtaaccatcgaaaccagatattgttggagcaggcggcggtcacctcaacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatacgaggcagaggcacacagctcaacgacgagttggtgagctcttcaatcggtctgcgaccggacggagtgttccaactagccggagccgggagatcgtccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcttatggtgactcggctgagctcgctcggttgaggcacctagaccactgccgccgcctgcgctgcttcgcccgggagagctgcggacttatctactttgagtttcccgaggagcaccccaacggccctgcacacggagtgcggatcaccgtagagggcaccaccgagtctcacctggttaggttcttcacccagcaacccttcctggtcgagcgggaccggggaggcaccacctacaccgtctactgcatctgtccaaccccgaagttgcatgagaatttttgttgtactctgtgtgctgagtttaataaaagctaaactcctacaatactctgggatcccgtgtcgtcgcactcgcaacaagaccttcaacctcaccaaccagactgaggtaaaattcaactgcagaccgggggacaaatacatcctctggctttttaaaaacacttccttcgcagtctccaacgcctgcgccaacgacggtattgaaatacccaacaaccttaccagtggactaacttatactaccagaaagactaagctagtactctacaatccttttgtagagggaacctaccactgccagagcggaccttgcttccacactttcactttggtgaacgttaccgacagcagcacagccgctacagaaacatctaaccttctttttgatactaacactcctaaaaccggaggtgagctctgggttccctctctaacagaggggggtaaacatattgaagcggttgggtatttgattttaggggtggtcctgggtgggtgcatagcggtgctgtattaccttccttgctggatcgaaatcaaaatctttatctgctgggtcagacattgttgggaggaaccatgaaggggctcttgctgattatcctttccctggtggggggtgtactgtcatgccacgaacagccacgatgtaacatcaccacaggcaatgagaggagtgtgatatgcacagtagtcatcaaatgcgagcatacatgccctctcaacatcacattcaaaaaccgtaccatgggaaatgcatgggtgggcgactgggaaccaggagatgagcagaactacacggtcactgtccatggtagcaatggaaatcacacttttggtttcaaattcatttttgaagtcatgtgtgatatcacactgcatgtggctagacttcatggcttgtggccccctaccaaggataacatggttgggttttctttggcttttgtgatcatggcctgtgcaatgtcaggtctgctggtaggggctttagtgtggttcctaaagcgcaagcctaggtatggaaatgaggagaaggaaaaattgctataaatctttttctcttcgcagaaccatgaatacagtgatccgtatcgtgctgctctctcttcttgtaacttttagtcaggcaggatttcataccatcaatgctacatggtgggctaatataactttagtgggaccctcagatattccagtcacatggtatgatagcactggattgcaattttgtgatggaagtacagttaagaatccacagatcagacatagttgtaatgatcaaaacttaactctgattcatgtgaacaaaacccatgaaagaacatacatgggctataataagcagagtactcataaagaagactataaagtcacagttataccacctcctcctgttactgtaaagccacaaccagagccagaatatgtgtatgttaatatgggagagaacaaaaccttagttgggcctccaggaattccagttagttggtttaatcaggatggtttacaattttgcattggggataaagtttttcatccagaattcaaccacacctgtgacatgcaaaatcttacactgttgtttataaatcttacacatgatggagcttatcttggttataatcgccagggaactgaaagaacttggtatgaggttgtagtgtcagatggttttccaaaatcagaagagatgaaggtagaagaccatagtaaagaaacagaacaaaaacagactggtcaaaaacaaagtgaccataagcagggtgggcaaaaagaaacaagtcaaaagaaaactaatgacaaacaaaagccatcgcgcaggaggccatctaaactaaagccaaacacacctgacacaaaactaattacagtcactagtgggtcaaacgtaactttagttggtccagatggaaaggtcacttggtatgatgatgatttaaaaagaccatgtgagcctgggtataagttagggtgtaagtgtgacaatcaaaacctaaccctaatcaatgtaactaaactttatgagggagtttactatggtactaatgacagaggcaacagcaaaagatacagagtaaaagtaaacactactaattctcaaagtgtgaaaattcagccgtacaccaggcctactactcctgatcagaaacacagatttgaattgcaaattgattctaatcaagacaaaattccatcaactactgtggcaatcgtggtgggagtgatcgcgggctttgtaactctaatcattattttcatatgctacatctgctgccgcaagcgtcccaggtcatacaatcatatggtagacccactactcagcttctcttactgaaactcagtcactctcatttcagaaccatgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatttgtgaatggaatgttactgcatacaaatgcttcaataatggaagcattactattactgccactgccaacattacttctggcacatacaaagctgaaagctataaaaatgaaattaaaaaattaacctataaaaacaacaaaaccacatttgaagattctggaaattatgagcatcaaaaattatctttttatatgttgacaataattgaactgcctacaaccaaggcacccaccacagttagtacaactacacagtcaactgttaagaccactactcacactacacagctagacaccacagtgcagaataatactgtgttggttaggtatttgttgagggaggaaagtactactgaacagacagaggctacctcaagtgcctttatcagcactgcaaatttaacttcgcttgcttggactaatgaaaccggagtatcattgatgcatggccagccttactcaggtttggatattcaaattacttttctggttgtctgtgggatctttattcttgtggttcttctgtactttgtctgctgtaaagccagaaagaaatctaggaggcccatctacaggccagtgattggggaacctcagccactccaagtggatggaggcttaaggaatcttcttttctcttttacagtatggtgatcagccatgattcctaggttcttcctatttaacatcctcttctgtctcttcaacatctgtgctgcctttgcggcagtttcgcacgcctcgcccgactgtctagggcctttccccacctacctcctctttgccctgctcacctgcacctgcgtctgcagcattgtctgcctggtcatcaccttcctgcagctcatcgactggtgctgcgcgcgctacaattaccttcatcatagtcccgaatacagggacgagaacgtagccagaattttaaggctcatatgaccatgcagactctgctcatactgctatcgctcttatcccatgccctcgctactgctgattactctaaatgcaaattggcggacatatggaatttcttagactgctatcaggagaaaattgatatgccctcctattacttggtgattgtgggaatagttatggtctgctcctgcactttctttgccatcatgatctacccctgttttgatcttggatggaactctgttgaggcattcacatacacactagaaagcagttcactagcctccacgccaccacccacaccgcctccccgcagaaatcagtttcccatgattcagtacttagaagagccccctccccgacccccttccactgttagctactttcacataaccggcggcgatgactgaccaccacctggacctcgagatggacggccaggcctccgagcagcgcatcctgcaactgcgcgtccgtcagcagcaggagcgtgccgccaaggagctcctcgatgccatcaacatccaccagtgcaagaagggcatcttctgcctggtcaaacaggcaaagatcacctacgagctcgtgtccaacggcaaacagcatcgcctcacctatgagatgccccagcagaagcagaagttcacctgcatggtgggcgtcaaccccatagtcatcacccagcagtcgggcgagaccaacggctgcatccactgctcctgcgaaagccccgagtgtatctactcccttctcaagaccctttgcggactccgcgacctcctccccatgaactgatgttgattaaaaaccaaaaaaaacaatcagccccttcccctatcccaaattactcgcaaaaataaatcattggaactaatcatttaataaagatcacttacttgaaatctgaaagtatgtctctggtgtagttgttcagcagcacctcggtaccctcctcccaactctggtactccagtctccggcgggcggcgaactttctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcccccctttgtctcctccgatggattcaaaaacttcccccctggggtcctgtcactcaaactggctgacccaatcaccatagccaatggtgatgtctcactcaaggtgggagggggacttactttgcaagaaggaagtctgactgtagaccctaaggctcccttgcaacttgcaaacaataaaaaacttgagcttgtttatgttgatccatttgaggttagtgccaataaacttagtttaaaagtaggacatggattaaaaatattagatgacaaaagtgctggagggttgaaagatttaattggcaaacttgtggttttaacagggaaaggaataggcactgaaaatttgcaaaatacagatggtagcagcagaggaattggtataagtgtaagagcaagagaagggttaacatttgacaatgatggatacttggtagcatggaacccaaagtatgacacgcgcacactttggacaacaccagacacatctcctaattgcaggattgataaggagaaggattcaaaactcactttggtacttacaaagtgtggaagtcaaatattagctaatgtgtctttgattgtggtgtcaggaaaatatcaatacatagaccacgctacaaatccaactcttaaatcatttaaaataaaacttctttttgataataaaggtgtacttctcccaagttcaaaccttgattccacatattggaactttagaagtgacaatttaactgtatctgaggcatataaaaatgcagttgaatttatgcctaatttggtagcctacccaaaacctaccactggctctaaaaaatatgcaagggatatagtctatgggaacatatatcttggaggtttggcatatcagccagttgtaattaaggttacttttaatgaagaagcagatagtgcttactctataacatttgaatttgtatggaataaagaatatgccagggttgaatttgaaaccacttcctttaccttctcctatattgcccaacaataaaagaccaataaacgtgttttttatttcaaattttatgtatctttattgatttttacaccagcgcgagtagtcaatctcccaccaccagcccatttcacagtgtacacggttctctcagcacgggtggccttaaatagggaaatgttctgattagtgcgggaactggacttggggtctataatccacacagtttcctggcgagccaaacggggatcggtgattgaaatgaagccgtcctctgaaaagtcatccaagcgggcctcacagtccaaggtcacagtctggtggaacgagaagaacgcacagattcatactcggaaaacaggatgggtctgtgcctctccatcagcgccctcagcagtctctgccgccggggctcggtgcggctgctgcagatgggatcgggatcacaagtctctctaactatgatcccaacagccttcagcatcagtctcctggtgcgtcgagcacagcaccgcatcctgatctctgccatgttctcacagtaagtgcagcacataatcaccatgttattcagcagcccataattcagggtgctccagccaaagctcatgttggggatgatggaacccacgtgaccatcgtaccagatgcggcagtatatcaggtgcctgcccctcatgaacacactgcccatatacatgatctctttgggcatgtttctgtttacaatctggcggtaccaggggaagcgctggttgaacatgcacccgtaaatgactctcctgaaccacacggccagcagggtgcctcccgcccgacactgcagggagccaggggatgaacagtggcaatgcaggatccagcgctcgtacccgctcaccatctgagctcttaccaagtccagggtagcggggcacaggcacactgacatacatctttttaaaatttttatttcctctgtggtgaggatcatatcccaggggactggaaactcttggagcagggtaaagccagcagcacatggtaatccacggacagaacttacattatgataatctgcatgatcacaatcgggcaacaggggatgttgatcagtcagtgaagccctggtttcatcatcagatcgtggtaaacgggccctgcgatatggatgatggcggagcgagctggattgaatctcggtttgcattgtagtggattctcttgcgtaccttgtcgtacttctgccagcagaaatgggcccttgaacagcatatacccctcctgcggccgtcctttcgctgctgccgctcagtcatccaactgaagtacatccattctcgaagattctggagaagttcctctgcatctgatgaaataaaaaacccgtccatgcgaattcccctcatcacatcagccaggactctgtaggccatccccatccagttaatgctgccttgtctatcattcagagggggcggtggcaggattggaagaaccatttttattccaaacggtctcgaaggacgataaagtgcaagtcacgcaggtgacagcgttcccctccgctgtgctggtggaaacagacagccaggtcaaaacccactctattttcaaggtgctcgaccgtggcttcgagcagtggctctacgcgtacatccagcataagaatcacattaaaggctggccctccatcgatttcatcaatcatcaggttacattcctgcaccatccccaggtaattctcatttttccagccttggattatctctacaaattgttggtgtaaatccactccgcacatgttgaaaagctcccacagtgccccctccactttcataatcaggcagaccttcataatagaaacagatcctgctgctccaccacctgcagcgtgttcaaaacaacaagattcaataaggttctgccctccgccctgagctcgcgcctcaatgtcagctgcaaaaagtcacttaagtcctgggccactacagctgacaattcagagccagggctaagcgtgggactggcaagcgtgagggaaaactttaatgctccaaagctagcacccaaaaactgcatgctggaataagctctctttgtgtctccggtgatgccttccaaaatgtgagtgataaagcgtggtagtttttctttaatcatttgcgtaatagaaaagtcctgtaaataagtcactaggaccccagggaccacaatgtggtagcttacaccgcgtcgctgaagcatggttagtagagatgagagtctgaaaaacagaaagcatgcgctaaactaaggtggctattttcactgaaggaaaaatcactctttccagcagcagggtacccactgggtggcccttgcggacatacaaaaatcggtccgtgtgattaaaaagcagcacagtaagttcctgtcttcttccggcaaaaatcacatcggactgggttagtatgtccctggcatggtagtcattcaaggccataaatctgccctgatatccagtaggaaccagcacactcacttttaggtgaagcaataccaccccatgcggaggaatgtggaaagattcagggcaaaaaaaattatatctattgctagccccttcctggacgggagcaatccctccaggactatctatgaaagcatacagagattcagccatagctcagcccgcttaccagtagacaaagagcacagcagtacaagcgccaacagcagcgactgactacccactgacttagctccctatttaaaggcaccttacactgacgtaatgaccaaaggtctaaaaaccccgccaaaaaaaacacacacgccctgggtgtttttgcgaaaacacttccgcgttctcacttcctcgtatcgatttcgtgacttaacttccgggttcccacgttacgtcacttttgcccttacatgtaacttagtcgtagggcgccatcttgcccacgtccaaaatggcttacatgtccagttacgcctccgcggcgaccgttagccgtgcgtcgtgacgtcatttgcatcaacgtttctcggccaatcagcagtagccccgccctaaatttaaaacctcatttgcatattaacttttgtttactttgtggggtatattattgatgatgagatctacaacttatatcgtatggggctgacttcaggtgctacatttgaagagataaattgcactgaaatctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgcgatcgcttaattaatttaaatcctgcagggtttaaacggccggcctagggataacagggtaatcgtaactataacggtcctaaggtagcgaatgatgtccggcggtgcttttgccgttacgcaccaccccgtcagtagctgaacaggagggacagctgatagaaacagaagccactggagcacctcaaaaacaccatcatacactaaatcagtaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaa

SEQ ID NO: 1416 - DNA, 833 bp, Adenovirus F41
  MISC_FEATURE (1)..(833): F41.ORF00001 E1A
atgagaatgctgccggacttcttcaccgggaactgggatgacatgttccaggggctgctggaggctgagcatctgtttgattttcctgaaccttctcaggcttttgaagagatttcgcttcacaatctttttgatgtggagctggatgagtctgaaggggatccgaatgaggaagcggtagatggtatgtttcctaactggatgctgtccgaggaccacagtgctgacagtggtgcggcttcgggcgattctggggttggagaagacctggtggaggttaatttggacttgaaatgctatgaagagggtttgcctcctagcggctcggaggctgatgaagctgaagaacgagcggaggaggaagagacggctgtgtcgaattatgtgaatattgctgagggtgctagtcagctggtgttggactgtccagaaaacccgggacgaggttgtcgggcttgtgattttcatcggggctctagtggaaatcctgaagctatgtgtgctttatgttacatgcgtctgaccggtcactgcatttacagtaagtagagatttttttttttgttttatactgctggatgatgtgtgggggttaacgtgcttttttgtgcttactaggtccgatttcagatgcggaaggagagtgtgagttggggtcaaatgaggagactgagctgccttgttctttgaccgccacggcaccagtaagacccaccccatgcagagtttcctgtagacgacgcccagccgttgattgcatagaagatttacttgaggaggatccgacggatgaacctttaaacttgtccttaaagcgccccaagtcctcttga

SEQ ID NO: 1417 - DNA, 513 bp, Adenovirus F41
  MISC_FEATURE (1)..(513): F41.ORF00002 E1B 19K
atggagttttggagtgagctacaaagttatcagagcctccgacgcttgctggagttggcttctgccagaacttccagctgttggaggtttatttttggttcaaccttaactaatgtaatttatagagctaaagaggactactcttcgcgatttgctgagcttttgtcttttaaccctggaatttttgcatctttaaatttgggccaccactcatttttccaggaaattgtgatcaaaaacttagatttttcttcccccggccgtacggtttctgggcttgctttcatttgttttatattggatcaatggagcgcccaaacccatctgtcggaggggtatactctggattacatgacaatggccctgtggagaaccctgctgcggaggaagagggtcttaggttgctcgccggcgcagcctccgcacggtctggatccagtgcgggaggaggaggaggaggaggaggaggaggagaacctgagggccggtctggatcctcaaacggaattgtaa

SEQ ID NO: 1418 - DNA, 1419 bp, Adenovirus F41
  MISC_FEATURE (1)..(1419): F41.ORF00003 E1B 55K
atggagcgcccaaacccatctgtcggaggggtatactctggattacatgacaatggccctgtggagaaccctgctgcggaggaagagggtcttaggttgctcgccggcgcagcctccgcacggtctggatccagtgcgggaggaggaggaggaggaggaggaggaggagaacctgagggccggtctggatcctcaaacggaattgtaactgaacctgaccccgaagagggtactagcagtgggcaaaggggggagaaaaggaagttagaaaatgacggggcggattttctaaaggagttaaccttgagtttaatgtctcgttgttatcctgagtctgtctggtgggctgatttggaagatgagtttaaaaatggaaacatgaatcttttatacaagtatggatttgaacagctgaaaacacattggatggagccttgggaggactgggaactagctttgaatatgtttgccaaagtggctcttcgcccagacactatttataccattaagaaaactgttaatatacgtaaatgtgcctatgtaattggaaatggagccgtggttagattccaaacctttgaccgggtggtttttaactgtgcaatgcagagtttaggtcctggggtgattggtatgagcggggtaacatttaataatgtcagatttgcagcagatggatttaatggcaaggtgtttgcttctaccactcaattaactttgcatggtgtgttttttcaaaattgcagcggtgtttgcgtggattcctggggtagggtgtctgccagaggttgtacgtttgtgggatgttggaaagggctggtggggcaaaacaagagccaaatgtctgtaaaaaaatgtgtgtttgaacgatgcattttggctatggtggtagaaggccaggcgcgaattcgacataatgcgggttccgaaaatgtgtgctttttactgctgaagggaactgccagtgttaagcataatatgatttgtggcactggtcactctcagctgctaacttgcgcagatggaaactgtcagactctaaaagtgattcatgtggtttcccatcagcgccgcccctggcctgtttttgagcataacatgcttatgcgttgtaccatgcatttgggggctcgtcgtggcatgttttctccatatcagagtaatttttgccatactaaagttttaatggaaactgatgctttttcgcgggtgtggtggagcggggtgtttgatttgaccatagagctgtataaagtggtgagatatgatgagttaaaggctcgttgtcgcccctgtgagtgtggagccaatcacatcaggttatatccagcaactctgaacgtgacggagcagctgcgcacggaccatcagatgttgtcgtgtcttcgcaccgactacgaatccagcgatgaggattaa

SEQ ID NO: 1419 - DNA, 402 bp, Adenovirus F41
  MISC_FEATURE (1)..(402): F41.ORF00004 IX
atgagcggctccatggaagggaacgctgtgagttttaagggtggggtgtttagcccatatttgacaacccgtcttcccgcttgggcaggagtacgtcagaatgtgatgggctccaacgtggacggtcgtcctgtcgcccccgccaattcagcaacccttacctatgccactgttggatcgtcggtggacaccgctgcggctgctgccgcttctgccgctgcctctactgctcgtggtatggcagctgattttggactttacaatcaactggctgcgtctcggtcgttgagggaagaagatgccctgtctgtggtgctgacccgcctggaggagctgtctcagcaattgcaagatttgtttgccaaagtggccctgcttaaccctcccgctaatgcttcttaa

SEQ ID NO: 1420 - DNA, 1619 bp, Adenovirus F41
  MISC_FEATURE (1)..(1619): F41.ORF00005 IVA2
ttatttgtttcttttgcggtaggccctggaccacctgtcgcggtcgttgaggactttgtggatgttttccaagacccggtacaaatgggcttggatgtttagatacatgggcataaggccgtccctggggtggaggtaggaccactggagggcgtcatgctcgggggtggtgttgtaaataatccaatcgtaacagggtttttgggcatgaaactgaaatatgtccttaaggagcaggctaatggccaggggtagtcccttggtaaaagtattaacaaatcgattaagttgggaaggatgcatgcggggggagattagatgcatttttgcctggatttttagattggcaatgttacccccgaggtcccgtctggggttcatgttgtgcaggaccaccagcacggtgtagccggtgcatttggggaatttgtcatgcaacttggaagggaaggcgtggaaaaactttgaaacccctttgtgaccccccagattttccatgcactcatccataattatggcgatgggacctttggccgcagctttagcaaaaatgttattggggtgggatacatcatagttttgctccaacgtgagctcgtcataggccattttaacaaagcggggaagaagggttcctgactgggggattatggtaccttccggaccgggggcatagttaccctcgcaaatttgcatctcccaagccttaatttcggatgggggaatcatgtccacttggggggcgatgaaaaaaacggtttcggggggaggattaataagctgggaggaaagcaggttccgcagaagctgggatttgccgcagccagtggggccataaatgaccccgatgacaggctgcaattggtagtttaaggagctgcagctgccgtcttcccgcaggagtggggtaacttcgttcatcatgcttctgacatgctggttttccctgaccaggtcttgcaagagacgttcaccacccagggaaagaagctcttccaagttgcggaaatgctttagtggttttaggccgtcggccatggtcattttttccaaagactgacgtagaagatagagccgatcccagagctcggtgatatgctctatggcatctcgatccagcaaacttcttggttgcggggattgggccggctttggctgtacggtaccagccggtgggcgtccagaggggcgagggtgatgtctttccaaggccgaagagttcgcgttagggtggtctcggtgacagtgaagggatgcgctccgggctgggcgcttgccagggttctcttcaggctcatcctgctggtgtgaaagcgcgcgtcttcgccctgagagtcagccaagtagcattttagcatcagctcatagcttagggcttcggctgcgtgtcctttggctcgaagcttgcctttggaaatgtgctgacagctgggacagtagaggcatttcagggcgtagagtttgggtgccaggaagacagattccggcgagtaagcgttggcaccgcactgtgcacacgtggtttcgcactccactaaccaggttagttcgggattttttggatcaaaaaccagactgcccccgtgttttttgatgcgtttcttacctcgggtttccat

SEQ ID NO: 1421 - DNA, 8433 bp, Adenovirus F41
  MISC_FEATURE (1)..(8433): F41.ORF00006 E2B DNA POL
ctatggcatctcgatccagcaaacttcttggttgcggggattgggccggctttggctgtacggtaccagccggtgggcgtccagaggggcgagggtgatgtctttccaaggccgaagagttcgcgttagggtggtctcggtgacagtgaagggatgcgctccgggctgggcgcttgccagggttctcttcaggctcatcctgctggtgtgaaagcgcgcgtcttcgccctgagagtcagccaagtagcattttagcatcagctcatagcttagggcttcggctgcgtgtcctttggctcgaagcttgcctttggaaatgtgctgacagctgggacagtagaggcatttcagggcgtagagtttgggtgccaggaagacagattccggcgagtaagcgttggcaccgcactgtgcacacgtggtttcgcactccactaaccaggttagttcgggattttttggatcaaaaaccagactgcccccgtgttttttgatgcgtttcttacctcgggtttccatgaggcgatgaccggcttcggtgacaaagaggctgtcggtgtcgccgtataccgatttgagggtacgctgctccaacggcgtgcctcggtcctccgcgtacagaaactcggaccattctgagacaaaagcccgggtccaggccagaacaaaggaggcaatttgggaggggtagcggtcgttttccaccagggggtcaaccttttctagggtgtgaaggcaaaggtcatcttcctctgcatccataaatgtgattggtttataagtataggtcacgtgacctttggggtcttgcgtgggtgtataaagggcgtgtccgcgttcttcatcactttcttccgcatcgctgtgggcaagagccagctgttcgggtgagtacgcgcgctggaaggcgggcataacttcagcactcaaggtgtcagtttctacgaacgaggtggatttgattttaatttgtcccgcggcaatgcttttgatggtggcagggtccatctggtcagaaaacacaatttttttattatctagtttggtagcaaacgacccgtaaagggcgttggaaagcagcttggcaatggaacgcagcgtctggtttttctcgcgatcggcccgctccttggcggcgatgttgagctgcacgtactttcgtgccacgcagcgccactcgggaaagacagtggtgcgctcgtcaggaagcaaccgtacctgccacccgcggttgtgcagggtgatcagatctatgctagtggccacctcgccccttaggggctcgttggtccagcacaagcgtcctcccttgcgcgagcagtatgggggtagtacatctagtaagttttcagatggagggtcagcgtcaatggtgaagatgccaggaagtaggacgtggttgaaatagtcaatgggagtgtcaacttgcaacagagcgcgttcccagtctcgaaccgctagggcgcgttcgtagggattgagcggcgagccccacggcatgggatgggtaagcgcggaggcgtacatgccacatatgtcgtaaacataaagaggttcacggagcaccccaatgtaagtgggatagcaacgtcctccgcgaatgctggccctgacataatcatacatttcatgtgagggggctagtagtccattgcctagatccgaacgcttaggttttacgctttggtacaagatctgtctaaagatggcgtgggagttggaggaaattgtgggcctttgaaaaacgttaaatttggcttcgggcagacccacggcatcacagatgaattgggcgtaggactctcgcagcttctgtaccaaggcggcggtgacaagcacatccaaagcgcagtagtcaagggtttcgcgtatcagatcataacgagactgttgcttcttttcccaaagttcgcggttcaggaggtactcctcgcggtccttccagtaatcttcggccggaaagccacgttcgtctgcacggtaggaacccaacatgtaaaattggttgacagctttgtaaggacagcagcctttttccaccggaagagcgtacgcttgcgcggcctttctcagagaggtgtgtgtaagagcgaaggtgtcgcgcaccatgactttgaggaattggtgtttaaagtcagtgtcgtcgcaggcgccctgctcccagaggtgatagtcggtgcgctttttggatagcggatttggtagggcaaatgtaatgtcattgaaaaggattttgccggcccgtggcataaagttgcgggtgattttgaaaggtccgggcacgtccgagcggttgttaatcacctgagccgccagcacaatttcatcaaagccgttgatgttatgtcccacaatgtagagttccacaaatcggggtgttccctgtagtttgggggccttttttaactcctcgtaagtaagattatcaggagaaaatagtcccatttcaagtcgggcccattcggccacttggggattggcagcaaggaacgcttgccacagctgggtggcaaaatgggtttgcaaacggtcgcggtagtttcgaaacttttttcctaccgctattttttcgggggtgaccacgtaaaaggtatggccgtcatttccccaggcatcccattgtagttcgtgggccagacggcaggcttcctccactagggtgtcatcccccgagagatgcataactagcataaacgggaccagttgcttaccaaaggctcccatccacgtgtaggtctcaacgtcgtaggtgacgaagaggcgttcaacgcggggatgagagccgatcggaaagaaattgatctcctgccaccagccggaggactgggcgttgatatgatgaaagtagaagtttctccggcggaccgtgcattcgtgctgatatttgtaaaagcgggcgcaatactcgcagcgttgcacgttctgcacctcttgaatgaggtgtacctggtgccctcgcacgagaaatcggagagggaaattaagaggctcctgagcgctctgcctttctccctcgttgttctcttctgcacctgcacgctcctgctgtgggaggatgacggagggagtgacgatgccccgcgaggcgcaggtccaaacctcgacgcggggaggctgaagcctgagagcgagagagcggatttgggagctgtccagggagtccaggaaggcttcgctgaggccggcgggcaaagaacgaaggttaacttgcagaaggcgggtaagggcggacgccaggcgttgatgaaacttaatttcaaggggggagttggtggaagtgtcaatagcgtagaggagaccttgtcctcgggaggctacaatggttcctcggaggcggaaggttgagggagggtttacatcatttgacgcggacgggcgcctgggggcagtggcggttcgggacccgcctgaagaggaggtagaagcacgttggcctggagctcgggtagcggttgatgctgagcccgcagctgactggcgtgcgcgacaacgcggcggttgagttcctggatacgtctttgttgagtgaagaccaagggtccccggactcggaacctgaaagaaagttcaacagaatcaatctccgcatcgttgaccgcgacctgacgcagaatttcctgcacgtcgcccgagttgtcttggtatgcgatctcggacataaactgatcgatctcttcctcctggagctccccccaaccggcccgctccacggtggccgcaagatcgttggagatgcgacccatgagctgggagaaggcgttaagcccgttttcgttccacacacggctgtagacaacgtcaccagtgtcgtcccgggcgcgcattaccacctgggccacgttaagctcaacgtgacgggcaaacacggcgtagttgcgcaagcgctggaaaaggtagttgagggtggtggcaatgtgctcacagacaaagaagtacataacccaacgccgaagagtcatttcgttgatattgccaagggcttccaagcgttccatggcttcgtaaaagtctaccgcaaagttgaagaattgggagttgcgggccgcgactgtcagctcgtcttgcaagaggcggattagctccgccacagtttctcgcacttcgcgttcaaaggcgcccggcgcttcctcgatttcttcttccatgagttcttcctcctctgcaacaggcacctcgggactcgcgggtgccggaacaggtcgtcggcggcgacgcctaatgggcagccgatcgacaaagcgttcgatgatttctccgcggcgacgacgcatggtttcagtgacggcgtgtccgttctctcggggtcgcagctcgaatacaccgccttgcaatcccgttccggagatgggtggtagcaggtggggtccttcgggcagagacagggcgctaactatgcatttgattatctgttgtgtaggcagagattgccaagcgttgttgagcaagtccaattggacgggatcagaaaacttttcaaggaaagcatcgagccaatcacagtcgcaaggtaagctcagaacggtgggctgtgggtttccacgggaggtgatgctgctgatgagatagttgaagtaggcggttttcaaacggcggatggtggcaaggaggataacgtcttttggtccggcctgttggatccgcaggcggtcggccatgccccaggcttcgctctgacatcgacgtagatccttgtagaagtcttgcatgagtctttccacgggaatttctatatctcctcggtcggccatgcgggtagagccgaacccgcggagaggctccaggagggccaggtcggcgaccactctttctgccagcacggcttgctgaatttgagtaagggtgttttggaagtcatctaagtccacaaagcggtgataagagccggtgttaatggtgtacgtgcagttggccatgacggaccagtttacaacttgcattccgggctgggtgatctctgtgtacctaaggcgggagtaggctcgggactcaaagacgtagtcgttgcaggttcgcaccaagtactggtagccaaccaggaagtgaggcggcggttcgcggtagaggggccatcgtagggttgctggggcgcccggcgcaaggtcctccagcataagacgatggtaatggtaaacatagcgagagagccaggtaattccggctgaggtggtcgcagcgcgggtgaactcgcggactcggttccagatgttgcgcaacggtgagaaacgctccatggtgggcacgctttggccggtaagacgggcgcaatcttgtacgctctagatggaaaaatagagagcaatcacggactcttctccgtagcctggaggatagaccgccagggtgcggtggcgaacaacccccggttcgagaccggctggatccgccactcccgacgcgccggccccgtgtccacgacggaaaccccgccgagacctagccgcggtccccggatctccagatacggaggggagtctttttgtcgttttttgtagatgcatccggtgttgcgacagatgcgtccgacgcagccaacgctcccgccccccactagcgcccaggccgccgtggctctttccggagccggcggtggcgaccctgacgaggaggccatgctggatttggaagagggcgagggtttggctcgcctgggagcaccctcccccgagcatcatccccgcgtacaacttaaaagggacgcacgtcaggcctacgtgccgccgcagaacctgtttagggatcgcagcggacaggaacccgaagagatgagggaccgcaggtttcatgcgggaaaggaactgcgggccggtttcaacagccaaagggtgctgcgcgccgaagactttgagcccgacaagcgtagtggagtaagtccggcacgggctcacgtgtcggcggccgatctggtgactgcgtacgagcaaactgtaaacgaggagcgcaactttcaaaaaacctttaacaatcacgtgcgcaccttagtagcgcgagaagaggtggccataggcctgatgcatttgtgggactttatggaagcgtacgtgcagaatccggcaagcaaaccgctgacggcacagctgtttttgattgtacaacacagccgcgataatgaaacttttcgagaagctatgcttaacattgctgagcccgaggggcgctggcttttagacctagtcaacatcctgcagagcatagtggtgcaagagcgcagcttgagcctggccgacaaggtggcggccattaattacagcatgctcagtctcggcaagttttacgcccgcaagatctacaaaactccttacgtgcccatagacaaggaggtgaaaattgatagtttttacatgcgtatggcgctgaaggtgttgacgctgagcgacgatctgggggtttaccgcaacgaccgcattcataaggccgtgagtgccagccgccgccgcgaactgagcgaccgcgagttgatgcacagcctgcgtcgagcattgacgggggccggcggggatgccaatgccgagtcttactttgacatgggggcagatttgcaatggcagccaagtgcccgggctctagaggcggttggataccgcaacgcaatgcaggaggaggatgaggaggaggactacgaggacgagccctgatcggccaggtggtgtttttgtagatgcagcggtcgacggcggtggtggacgggtcgcagcaggtggatcctgccatgttggcagcactgcaaagccaaccctcgggcgtgaccccctcagacgactgggcggcggccatggaccgtattctagctttgaccacccgcaatcctgaagccttcaggcagcagccccaggccaacaggttttcggccattttggaagccgtggtaccctctcgtactaacccaacccacgagaaggtgctggctatcgtgaacgccctaacagaaagcaaagcaattcgcaaggacgaagcgggactgatttacaatgctctgctggaaagggtggcccgatacaacagtaccaacgtacaagccaatcttgaccgccttaccactgacgtgagggaggcggtagcacagcgggagcgctttatgcatgacactaacttgggttcccaggtggcgctaaatgcttttctgagcacgctcccggctaacgttccgcgcggacaggaggattacgttagctttatcagcgcattgcgcctcctggtggcagaagtacctcaaagcgaggtttaccagtcaggtcccgattactttttccaaacttcgcggcagggactgcagacggttaacttgacacaggccttcaaaaacttgcagggcatgtggggtgtgcgggcccccgttggtgaccgcgccaccatttccagtttgctgacgcccaatacccggctgttgttgctgctgattgccccatttacaaatagtagtaccatcagccgggactcataccttggccatctgatcactttgtaccgcgaggctatcggtcagacacaggtagacgaacaaaccttccaggaaatcaccagtgtgagccgtgcgttaggacagcaagacaccgggagtctggaagccactttgaacttcctgctcaccaaccggcaacagaaaattccctcgcaattcacactgagtaccgaggaggagcgtatcttgcgttacgtgcaacagtctgtcagtttatacttaatgcgcgaggggatgaccccatcctcggctctggatatgacggcccgcaacatggaaccgtcgctgtattcgtccaatcggcctttcattaaccgcctaatggactacctgcatcgcgcggcagccatgaacagcgagtactttactaatgccattttgaacccccattggatgcccccctctggtttttatacgggagaatttgacatgcccgagggagatgacggcttcttgtgggacgacgtgtccgacagcatttttgtccctgcgcgttaccgcaagaaggaaggcggtgatgagctgcctttgcccttggtggaagcggcttccaggggccagagccctttcccaagcctcccatcgcttgttagcagcagcaacagcggacgggtgttgcgtccccggcttccaggggagacggactacctaaacgatcccctgttgcaacccgttcgtaataagaactttcctaacaacggggtggaaagtttggtagataaaatgaatcgctggaagacctacgctcaggagcagcgggagtgggaggagagccagtcccgccctttggccggccctttcagccgttggcgccggcgagaagacgaccaggatgactccgccgatgacaatagcgttttggacttggggggaactggtgcttcttccaaccccttcgcccacctacgtcctcagggccgcttgggcagattgtattaaaaaaaaaaaaaaaaaaaaaaaccacttaccagagccat

SEQ ID NO: 1422 - DNA, 570 bp, Adenovirus F41
  MISC_FEATURE (1)..(570): F41.ORF0007 I-LEADER PROTEIN
atgagagccgatcggaaagaaattgatctcctgccaccagccggaggactgggcgttgatatgatgaaagtagaagtttctccggcggaccgtgcattcgtgctgatatttgtaaaagcgggcgcaatactcgcagcgttgcacgttctgcacctcttgaatgaggtgtacctggtgccctcgcacgagaaatcggagagggaaattaagaggctcctgagcgctctgcctttctccctcgttgttctcttctgcacctgcacgctcctgctgtgggaggatgacggagggagtgacgatgccccgcgaggcgcaggtccaaacctcgacgcggggaggctgaagcctgagagcgagagagcggatttgggagctgtccagggagtccaggaaggcttcgctgaggccggcgggcaaagaacgaaggttaacttgcagaaggcgggtaagggcggacgccaggcgttgatgaaacttaatttcaaggggggagttggtggaagtgtcaatagcgtagaggagaccttgtcctcgggaggctacaatggttcctcggaggcggaaggttga

SEQ ID NO: 1423 - DNA, 1878 bp, Adenovirus F41
  MISC_FEATURE (1)..(1878): F41.ORF0008 E2B PRETERMINAL PROTEIN
ttacatcatttgacgcggacgggcgcctgggggcagtggcggttcgggacccgcctgaagaggaggtagaagcacgttggcctggagctcgggtagcggttgatgctgagcccgcagctgactggcgtgcgcgacaacgcggcggttgagttcctggatacgtctttgttgagtgaagaccaagggtccccggactcggaacctgaaagaaagttcaacagaatcaatctccgcatcgttgaccgcgacctgacgcagaatttcctgcacgtcgcccgagttgtcttggtatgcgatctcggacataaactgatcgatctcttcctcctggagctccccccaaccggcccgctccacggtggccgcaagatcgttggagatgcgacccatgagctgggagaaggcgttaagcccgttttcgttccacacacggctgtagacaacgtcaccagtgtcgtcccgggcgcgcattaccacctgggccacgttaagctcaacgtgacgggcaaacacggcgtagttgcgcaagcgctggaaaaggtagttgagggtggtggcaatgtgctcacagacaaagaagtacataacccaacgccgaagagtcatttcgttgatattgccaagggcttccaagcgttccatggcttcgtaaaagtctaccgcaaagttgaagaattgggagttgcgggccgcgactgtcagctcgtcttgcaagaggcggattagctccgccacagtttctcgcacttcgcgttcaaaggcgcccggcgcttcctcgatttcttcttccatgagttcttcctcctctgcaacaggcacctcgggactcgcgggtgccggaacaggtcgtcggcggcgacgcctaatgggcagccgatcgacaaagcgttcgatgatttctccgcggcgacgacgcatggtttcagtgacggcgtgtccgttctctcggggtcgcagctcgaatacaccgccttgcaatcccgttccggagatgggtggtagcaggtggggtccttcgggcagagacagggcgctaactatgcatttgattatctgttgtgtaggcagagattgccaagcgttgttgagcaagtccaattggacgggatcagaaaacttttcaaggaaagcatcgagccaatcacagtcgcaaggtaagctcagaacggtgggctgtgggtttccacgggaggtgatgctgctgatgagatagttgaagtaggcggttttcaaacggcggatggtggcaaggaggataacgtcttttggtccggcctgttggatccgcaggcggtcggccatgccccaggcttcgctctgacatcgacgtagatccttgtagaagtcttgcatgagtctttccacgggaatttctatatctcctcggtcggccatgcgggtagagccgaacccgcggagaggctccaggagggccaggtcggcgaccactctttctgccagcacggcttgctgaatttgagtaagggtgttttggaagtcatctaagtccacaaagcggtgataagagccggtgttaatggtgtacgtgcagttggccatgacggaccagtttacaacttgcattccgggctgggtgatctctgtgtacctaaggcgggagtaggctcgggactcaaagacgtagtcgttgcaggttcgcaccaagtactggtagccaaccaggaagtgaggcggcggttcgcggtagaggggccatcgtagggttgctggggcgcccggcgcaaggtcctccagcataagacgatggtaatggtaaacatagcgagagagccaggtaattccggctgaggtggtcgcagcgcgggtgaactcgcggactcggttccagatgttgcgcaacggtgagaaacgctccat

SEQ ID NO: 1424 - DNA, 1140 bp, Adenovirus F41
  MISC_FEATURE (1)..(1140): F41.ORF0009 52-55K
atgcatccggtgttgcgacagatgcgtccgacgcagccaacgctcccgccccccactagcgcccaggccgccgtggctctttccggagccggcggtggcgaccctgacgaggaggccatgctggatttggaagagggcgagggtttggctcgcctgggagcaccctcccccgagcatcatccccgcgtacaacttaaaagggacgcacgtcaggcctacgtgccgccgcagaacctgtttagggatcgcagcggacaggaacccgaagagatgagggaccgcaggtttcatgcgggaaaggaactgcgggccggtttcaacagccaaagggtgctgcgcgccgaagactttgagcccgacaagcgtagtggagtaagtccggcacgggctcacgtgtcggcggccgatctggtgactgcgtacgagcaaactgtaaacgaggagcgcaactttcaaaaaacctttaacaatcacgtgcgcaccttagtagcgcgagaagaggtggccataggcctgatgcatttgtgggactttatggaagcgtacgtgcagaatccggcaagcaaaccgctgacggcacagctgtttttgattgtacaacacagccgcgataatgaaacttttcgagaagctatgcttaacattgctgagcccgaggggcgctggcttttagacctagtcaacatcctgcagagcatagtggtgcaagagcgcagcttgagcctggccgacaaggtggcggccattaattacagcatgctcagtctcggcaagttttacgcccgcaagatctacaaaactccttacgtgcccatagacaaggaggtgaaaattgatagtttttacatgcgtatggcgctgaaggtgttgacgctgagcgacgatctgggggtttaccgcaacgaccgcattcataaggccgtgagtgccagccgccgccgcgaactgagcgaccgcgagttgatgcacagcctgcgtcgagcattgacgggggccggcggggatgccaatgccgagtcttactttgacatgggggcagatttgcaatggcagccaagtgcccgggctctagaggcggttggataccgcaacgcaatgcaggaggaggatgaggaggaggactacgaggacgagccctga

SEQ ID NO: 1425 - DNA, 1740 bp, Adenovirus F41
  MISC_FEATURE (1)..(1740): F41.ORF00010 IIIA
atgcagcggtcgacggcggtggtggacgggtcgcagcaggtggatcctgccatgttggcagcactgcaaagccaaccctcgggcgtgaccccctcagacgactgggcggcggccatggaccgtattctagctttgaccacccgcaatcctgaagccttcaggcagcagccccaggccaacaggttttcggccattttggaagccgtggtaccctctcgtactaacccaacccacgagaaggtgctggctatcgtgaacgccctaacagaaagcaaagcaattcgcaaggacgaagcgggactgatttacaatgctctgctggaaagggtggcccgatacaacagtaccaacgtacaagccaatcttgaccgccttaccactgacgtgagggaggcggtagcacagcgggagcgctttatgcatgacactaacttgggttcccaggtggcgctaaatgcttttctgagcacgctcccggctaacgttccgcgcggacaggaggattacgttagctttatcagcgcattgcgcctcctggtggcagaagtacctcaaagcgaggtttaccagtcaggtcccgattactttttccaaacttcgcggcagggactgcagacggttaacttgacacaggccttcaaaaacttgcagggcatgtggggtgtgcgggcccccgttggtgaccgcgccaccatttccagtttgctgacgcccaatacccggctgttgttgctgctgattgccccatttacaaatagtagtaccatcagccgggactcataccttggccatctgatcactttgtaccgcgaggctatcggtcagacacaggtagacgaacaaaccttccaggaaatcaccagtgtgagccgtgcgttaggacagcaagacaccgggagtctggaagccactttgaacttcctgctcaccaaccggcaacagaaaattccctcgcaattcacactgagtaccgaggaggagcgtatcttgcgttacgtgcaacagtctgtcagtttatacttaatgcgcgaggggatgaccccatcctcggctctggatatgacggcccgcaacatggaaccgtcgctgtattcgtccaatcggcctttcattaaccgcctaatggactacctgcatcgcgcggcagccatgaacagcgagtactttactaatgccattttgaacccccattggatgcccccctctggtttttatacgggagaatttgacatgcccgagggagatgacggcttcttgtgggacgacgtgtccgacagcatttttgtccctgcgcgttaccgcaagaaggaaggcggtgatgagctgcctttgcccttggtggaagcggcttccaggggccagagccctttcccaagcctcccatcgcttgttagcagcagcaacagcggacgggtgttgcgtccccggcttccaggggagacggactacctaaacgatcccctgttgcaacccgttcgtaataagaactttcctaacaacggggtggaaagtttggtagataaaatgaatcgctggaagacctacgctcaggagcagcgggagtgggaggagagccagtcccgccctttggccggccctttcagccgttggcgccggcgagaagacgaccaggatgactccgccgatgacaatagcgttttggacttggggggaactggtgcttcttccaaccccttcgcccacctacgtcctcagggccgcttgggcagattgtattaa

SEQ ID NO: 1426 - DNA, 1527 bp, Adenovirus F41
  MISC_FEATURE (1)..(1527): F41.ORF00011 PENTON BASE
atgagacgagcggtgggagtgccacccgtgatggcatacgcagagggtcctcctccttcttacgaaagcgtgatgggatcagcggattcgccggcaacgctggaggcgctctacgttcctccccgctacctggggcctacggaagggcgaaacagcattcgttactcagagttggcgccgctatatgacaccacccgggtttatctagtggataacaaatcggcagacattgcctccttgaactaccaaaatgaccacagcaactttcaaaccacggtggtgcagaacaatgacttcacaccagcggaggcggggacgcaaaccattaactttgacgagcgctcgcggtggggtgctgacctaaaaacaatcctgcgcacaaacatgcccaacataaacgagtttatgtctaccaacaagtttaaagctcggctaatggtagaaaaaaaaaataaggagactggtttaccgcgctacgagtggtttgagtttaccttgcccgaaggaaactactcggaaactatgaccattgatcttatgaataacgccattgtagacaactacttggaagtgggaagacaaaacggcgtgctagaaagcgacataggggtgaagtttgacacgcgcaatttccgtttgggttgggacccggtaaccaagcttgtcatgccaggcgtgtacaccaatgaagcgtttcatccggatattgttctattgccggggtgcggagtggattttacgcagagtcgtcttagtaatctgctgggaatccgtaagcggctgccgtttcaagaaggttttcaaatcatgtatgaggatttggagggaggtaacattccggccttgttagacgttgcaaagtatgaagctagcattcagaaagccaaagaggagggaaaagaaattggcgacgatacttttgcaacccgcccccaagatctggtaatcgaaccagtggcaaaagatagcaaaaatcgcagctacaatttgctgcctaatgatcaaaacaacaccgcatatcgcagctggtttttagcctacaactatggagaccccaagaagggagtgcaatcctggactttattgaccacagcggacgtcacgtgcgggtcgcagcaggtgtactggtctttacccgacatgatgcaagacccagtaacttttcgcccgtctacgcaagtcagcaactacccagtagtgggggttgaattgctgccagtacacgccaaaagtttctacaatgagcaggccgtttactctcagcttatccgccagtccaccgcgcttacacacgtcttcaatcgctttcctgagaatcagatactggtgcgtccgcccgctccgaccattaccaccgtcagtgaaaacgttcccgccctcacagatcacggaaccctgccgctgcgcagcagtatcagtggagtccagcgcgtgaccatcactgacgcccgccgtcggacctgtccctacgtgcacaaagccctgggcatagttgctccaaaagtgctttctagccgcaccttttaa

SEQ ID NO: 1427 - DNA, 552 bp, Adenovirus F41
  MISC_FEATURE (1)..(552): F41.ORF00012 PVII
atgtctattctaatctcgcccgataataataccggctgggggttgcactctgccggcatgtatggcggtgccaaaaggcgttccagccagcatcctgttcgtgtgcgagggcattaccgcgctccctggggggcccacacccggggcataatttccgcccgcaccaccgttgatgacgtgattgactctgtagtagccgacgctagacggtatcagcgacccacgtccacggtggattccgtgattgacagcgtggtagcagatgccaggcgctatgcgcagcgcaaaagccgtttgcggcgtcgccggcgacgacccacgactgccatgattgccgctcgagcggtgttaaggcgtgcgcgtcggataggacggcgagccatgcgccgagccgctgccgctgccagtgctggtcgagcccgccgtcaggccgctcgccaggctgccgcggccattgccagcatggcccagccccggcgagggaatgtctactgggtaagggacgcatcgggtgtgcgggtgccggtgcgaactcgaccccctcgaagttag

SEQ ID NO: 1428 - DNA, 1047 bp, Adenovirus F41
  MISC_FEATURE (1)..(1047): F41.ORF00013 V
atgagcaagcgcaagttcaaagaagagctgctggaggcccttgtgcccgaaatctatggccctgcggcggacgtcaagcccgacattaagccccgtgccctgaagcgtgttaaaaagcgggaaaaaaaagaggaaactgggttgttagatgatggtgtggagttcgttaggacctttgctcctcggcgacaggtgcagtggcgtggacgcaaagtgaagcgcgtgctccgacctggcaccactgtggtgttcactcctggcgagcggtctgccacacgggcattaaagcgggaatacgatgaggtttatgccgacgaagatattctggagcaggcagcccagcaaattggcgagttcgcctacggcaaacgcggtcgttacggagaggtggggctgttgctggatcaaagtaacccgactccaagcctgaagcccgcaacgcagcagcagattcttccagtaacggaaaccaaacggggcgtcaaaagggaaaacaaagacgaattgcagcctacaatgcaactcatggtgcccaagcggcagaagctggaggaagtgctggaaaatatgaaagtggacccaagcgttgagccggaagtaaaagtgcgccccattaaggaaataggtccaggtctgggagtgcaaacggtggatattcagatccccgtacgtaccactccagcagtggcaatggcagaagccatggaaacgcagacagatcagcctgcgcctgtgactacccgggaaataggtttgcaaacggacccaaggtacgagtctgttacttccacccgccgctcgcgcgtaagaaagtatacagccgccaactctatcctaccggagtatgccttacatccgtcaattacgccgacgcctggctatcgcggtacaatcttcagacccagccgccctcgaaccacccgccgtcgtcgcactacccggcgtcgatcgcgtcgcattacacccatctccgtgcaccgtgtaacccgccggggccgcacaattaccctgcccaatgcgcgttaccaccccagcattctcatttaa

SEQ ID NO: 1429 - DNA, 210 bp, Adenovirus F41
  MISC_FEATURE (1)..(210): F41.ORF00014 L2 PMU
atggctctgacttgccggtttcgcatcccagtttcgtcctaccgaggaagatctcgccgtaggagaggcatgttgggcagcgggcgccgacgcgctttgcgcaggcgtatgaaaggcggatttttgcccgcgctgattcccattatcgccgccgccattggcgcaatcccaggcattgcctctgtggcgttgcaagcacgcaaacaataa

SEQ ID NO: 1430 - DNA, 801 bp, Adenovirus F41
  MISC_FEATURE (1)..(801): F41.ORF00015 VI
atggaagacatcaattttgcgtcgctggcgccgcgtcacggctcgcggccgttcatgggcacctggaacgagatcgggaccagccagctcaacgggggcgctttcagttggagtagcctgtggagtggcattaaaaactttgggtcctccattaagtcctttggcaacaaggcctggaacagtaacactggtcagatgctgcgagataagttgaaggaccagaacttccaacaaaaagtggtggacggtctggcctcgggtataaatggcgtggtggatattgctaaccaggccttacaaaaccaaatcaatcagaggctggagaatagccgccaacctccagtagctctgaagcagcgaccaactcccgaaccagaagaggtggaagtggaagaaaaattacccccgttggaaacggcacctcccttgcctagcaagggtgagaaacggccgcgtcccgagctggaggaaaccctggttgtggaatcccgcgagcccccctcgtacgagcaggctttgaaagaaggagcttcgtatcccatgaccagacccattggctccatggccagaccggtttatgggaaagaaaaaactcccgtaacgttagaattgccaccacccgcgcccaccgtaccgcctatgccggctcccaccctgggtaccaacgttccccgccttgcggccccaaccgttgctgtggccactccggctcgcagagttcgcggtgccaattggcagagcactttgaacagcattgtgggtttgggagtgaaaagcctaaaacgccgccggtgctattaa

SEQ ID NO: 1431 - DNA, 2778 bp, Adenovirus F41
  MISC_FEATURE (1)..(2778): F41.ORF00016 L3 Hexon
atggccaccccctcgatgatgccgcaatggtcttacatgcacatcgccgggcaggacgcctcggagtatctgagtccgggcctggtgcagtttgcccgcgccaccgatacgtacttcagcctggggaacaagttcagaaaccccactgtggctccgacccacgatgtaaccacagacaggtcacagcgactgacgctgcgattcgtgccagtcgaccgcgaggacaccgcttattcttacaaagtgcgctttacgctggccgtgggcgacaaccgggtgttggacatggccagcacctactttgacatccgcggcgtgctggatcgtggccccagctttaaaccctactccggaaccgcctataactccctggctcctaaaacagcacccaatccatgcgaatggaaggacaacaacaaaataaaagttagaggacaagcaccccttataggaacaaacatagacaaagacaatgggattcagataggaacagacgcaacgacgaagcctatttatgccgacaaaacatatcaaccagagcctcaagtgggccaaacacagtggaacagtgaagttggtgccactgacaaggtagcgggtagggtattgaaagataccacgccaatgttaccatgctacgggtcttacgccaaaccaacaaatgaaaagggtggtcaggccaatcttataacaaacggaaccgatcaaactctaacaagcgacgttaacttacagttctttgccttggcaaacactcctaatgtgccaaaagccgttctttacgctgagaatgtggctattgaagcgcccgacacccatttggtgtacaagccagatgtagctcagggaaccgtaagttcggcagatcttttaacgcaacaggcagcgcccaacagaccaaactacattggctttagggataacttcattggcctgatgtactacaactccacaggcaatatgggcgtattggctgggcaggcttcacagctaaatgctgtagtggacttgcaagacaggaacactgagttatcgtaccaacttatgctggatgctcttggcgatcggagcagatatttttccatgtggaatcaggctgttgacagttacgaccccgacgtaagaatcattgagaaccacggagtggaggacgaattgccaaattactgctttccgctgggagggtctgcagctacagacacgtattctggcataaaagcaaacagcggaaactggactgcggacgacacttatgccgacagaggggcagaaattgagtctgggaatatttttgccatggaaatcaatttggcggccaatctctggcgcagcttcttatattccaatgtagccctgtatttgcctgactcatacaaaattacgccagacaacattacactacccgaaaacaagaacacctatgcctacatgaacggtcgggtggcggttcctagcgcccttgatacctacgtaaacatcggggcacggtggtctccagatcccatggacaatgttaaccccttcaatcaccaccgtaacgccggtctgcgctatcggtccatgctcttgggcaacgggcgttacgtacccttccacattcaagtcccccagaagttttttgccattaaaaatctcctcctgttacctggttcctacacctacgagtggaacttcaggaaggacgttaacatgatcctccagagcagtctgggtaacgacctgcgggtcgacggagccagcgtcaggttcgatagcattaatctgtacgccaacttttttcccatggctcacaacaccgcctccaccttggaagctatgctgcgcaatgacaccaacgaccaatcgtttaacgactacctttgcgctgcaaacatgctttatcccattccttctaatgctactagcgttcccatttctattccttcgcggaactgggccgcttttcggggctggagttttactcgactgaaaaccaaagaaaccccctctttgggttcgggatttgatccctactttacctactctggctccgttccatacttggatggtaccttttacctcaaccacacttttaaaaaggtgtccatcatgttcgactcctctgtgagctggcctggcaatgaccgactgcttacccccaatgagtttgaaatcaaacgcaccgtggatggggaagggtacaacgtggctcaatgtaacatgaccaaagactggtttctgattcagatgcttagtcactacaacattggatatcagggtttttatgtacccgaaagctacaaagatagaatgtattcctttttccgaaacttccagccaatgagtcgtcaggtggtaaacactaccacctacaaggaatatcagaatgttacccttcctttccagcataataactcaggctttgtgggatacatgggacccaccatgcgggagggacaagcttaccccgctaactacccttacccccttattggccaaacggccgtgccaagcctgacacagaaaaaattcctgtgcgatcgcaccatgtggcgcattccgttttccagcaacttcatgtctatgggggcactgaccgacctggggcagaacatgctgtatgccaattccgcccacgccctcgacatgacttttgaggtcgatcccatggatgagcccacacttctttatgttttgtttgaagttttcgacgtcgtgcgcatccaccagccccaccgcggcgtcatcgaggccgtctacctccgtacgccgttctcggccggtaacgccaccacataa

SEQ ID NO: 1432 - DNA, 645 bp, Adenovirus F41
  MISC_FEATURE (1)..(645): F41.ORF00017 L3 Protease
atgggctccagcgagcaggagctggccgccatcgtgcgtgacctgggttgcggaccctactttctaggcacctttgacaaacgtttcccgggctttatggctccgaacaagctggcctgcgctattgtgaacacggccgggcgtgaaacagggggcgttcactggttggccctggcctggaaccccaagagccatacctgttacctctttgacccgtttggcttttcggacgagcggctcaaacaaatttaccagtttgaatatgagggcctactaaagcgaagcgctttggcttccacgcctgaccactgcattacccttgtgaaatctacccagaccgttcagggacctttttctgccgcctgtggtcttttctgctgcatgtttttgcatgcttttatacactggcccagtaatccaatggagcaaaatcccacaatggatcttctcacgggcgtacctaacagcatgcttcaaagcccccaggtcgaacccaccctgcgtcggaatcaggaacgattgtatcgttttttgacccaacactctccctactttcgtcgtcaccgcgagcgaattgaaaaagctacagcttttgatcaaatgaaaaatgctcaagtgttgtttcataataaaattttttattga

SEQ ID NO: 1433 - DNA, 1425 bp, Adenovirus F41
  MISC_FEATURE (1)..(1425): F41.ORF00018 E2A DBP
ttaaaagggctcaatctccgcatcgccgtgaccggtgggaagggccacgttgcgatattgcaaacgggtgctccacttgaattcgggaataatcaacttgggcaaagggtcttcgacgttttccttccaaaattgtcgtaccagctgcagggcgcttataacgtcaggcgcagaaattttaaaatcacaattggggccagcgctaccgcgcgaattgcggtatacgggattagcacactggaacactagcacacaggggtggagtatgctggcaagagccgacttgtcggtaacttcgttggtcttcagatcttccgcgccgctcaaagcaaatggggttaccttacacatctgccgacccaattggggtacaagatccttcttgttaagacactcacagcgcaaagggattaatatgcgttgctgaccgcgttgcatctgcgggtattcggcttgcagaaacgcttgcatttgtttaaatgctatttgggctttaagcccctccgaaaaaaacagcccgcaggacttgctagaaaacatgttgttgccacagctcacatcttccgcgcagcaccgcgcgtcgtcattcttgatttggaccacgctgcgaccccagcggttctgaacaactttggttttgctaggttgctccttgagggcgcgctggccattctcgctgccaacatctacctccacaacttgctccttctgtatcatttctcgcccgtggaagcatctcaacacgccttcctcccgggtacagccatgagcccaaacagcgcagccggttgtatcccagttgtggtgcttcaccccagcgtaggtttccacgtaggcagccaggaatcgacccatgagctctgtaaaggttttctgggtggtgaatgtcaaagacaatccgcggcgttcctcattcaaccaggtctgacatatcttgcgataaacggcgttttgttcaggaagaaacttaaaagctgttttttcgtcattctccacgtgatatttctccatcaggacgttcatgagctccatgcccttctcccaagccgaaaccaatgggtcaacctgggggtttgttatcagcatggtcactgccttggaagagccggattgattattttcttcctcttctggtggcgttagatccctggggataacggttttctccaaacgcctaatttgtcgcttgccattgcccttttgtactacttctacgcctggatagctgaacccgtggtacagcacctcttcgtcctcctcgctgtccggaaccacttcgggcgacaaggtcggagcgtgtacttgctccggtacttgcaagtttttgcgcagctttttcttgggaggcaatgacggagggcgctccgggctcgtctcctggaggtagggagtaacggtggggtgctctcgctgacggccagccat

SEQ ID NO: 1434 - DNA, 2334 bp, Adenovirus F41
  MISC_FEATURE (1)..(2334): F41.ORF00019 100K
atggaggaggatcttatacagccgcagccagactccgaaaccttaaccagccccacctctgaggtcggcgccgtcgaactagtggaacatgaggatgatgagcgagtggagcaagacccgggctatgtgacgccgcccaaggacggcaaggaatcggtgccggtgtcgccgctcaccgaagcagactacctgggaggggaggacgacgtgcttctaaaacatgtgttgcggcagagcaccattgtgcaggaggccttcaaggattactctgggtttccgctgacggtggaggagttgagtcggacctacgaagctaatctcttttcaccgcgtgtgcccccaaaaaagcaagccaatggaacctgcgagcccaatccgcgcctcaacttttatccagtttttgcagtccccgaagcgttggctacctatcatattttttttaagaaccaacgcatccccctatcatgtcgtgccaaccgcacccaaggagaccgcattttgcatctcaaagccggcgctcacatacctgagattgtttccttggaggaagttcccaagatatttgaaggtcttggcaaagatgaaaaacgggcagcaaacgctctgcaaaaaagtgaaaccgaaaatcagaacgttctggtggaactggatggcgataacgcgcgtctcgccgtgctcaaacgcaccatcgaagtttcccactttgcctaccctgctcttaaccttccccccaaagttatgcgttcagtcatggatcatctccttatcaagcgggtcgaacctttagattcagatcagcccgaacaaaactccgaggacggccagcccgtggtttctgacgacgatctcgcacgctggcttgacacccatgaccccaccactttgcaagaacggcgcaaaatgatgatggcggtcattctgattaccgttgagctcgagtgcttgcaacgcttctttgccaatccccagacgctgcgcaagattgaggaatccctccattatgctttccgtcatggctacgttcgacaagcgtgtaaaatttctaatgtagagcttagcaacttagtttcctacatgggaattttacacgaaaaccgcctggggcaaaacgttctccattgcactttgcaaggtgaggcccgccgcgactacgttcgcgactgcatttatcttttcctaatcctaacctggcaaaccgcaatgggtgtctggcaacaatgtctagaggagcgtaacctccgcgagcttgaaaaactgctggttcgaaatcgccgcgagctttggacagcttttagcgaacgcacggccgcttgccagctggccgatctgatttttcccgaacgactcatgcaaacgctgcaaaacggcttgccagactttgttagtcagagcattttgcaaaactttcgctcttttatcctcgagcgatccggtatcttaccggctatgagctgcgccctaccctccgatttcgttccactttgctaccgcgaatgcccgccgcctctctggagtcattgctatctcctccgcctggcaaactacctagcccaccactccgacctcatggaaaattccagcggcgaaggattgctagaatgccactgccgctgcaacctctgcacaccccaccgctctctggtctgcaataccgagctgctcaacgaaacccaagtaatcggtacctttgaaatccaaggaccagagcagcaagagggtgcttccaatcttaagcttactccggcgctctggacttcagcctatttgcgcaaatttattccagaggactatcacgcccaccaaattaagttctacgaagaccaatcccgacctcccaaagcccccctcacggcttgtgtcatcacccagagccaaattttggcccaattgcaagccatccagcaggcgcgacaggagtttctgctaaaaaaaggtcacggggtttacttggatccccagaccggtgaggaactgaataccccgtcaccctccgccgccgcttcgtgccgcccgcagaaacatgccgcccaaagggaacaagcaagccattgcggatcggcggtcccaaaagcaacagaaactgcaagagcagtgggacgaggaggaggaatcctgggacgacagccaggcagaggaagtttcagacgaggaggaaatggagagctgggaaagtctagacgaggagctggaggacaaaccccccaaggacgaggaggaagaaatcatcgccagcgctgcggcgccgtcttccaaagaacccgctcggagccagcctccgacggggaaagtcggaccgtccccgccgcggccaggcttgttgaaagccagccgtag

SEQ ID NO: 1435 - DNA, 702 bp, Adenovirus F41
  MISC_FEATURE (1)..(702): F41.ORF00020 PVIII
atgagtaaggaaattcccacgccttacatgtggagctatcagccacagatgggcttggcagctggagcatctcaggactactctagtcgcatgaactggctaagtgccggcccccatatgattgggcgcgtaaatggaattcgcgccactcgaaaccaaattttgctggagcaagctgccctgacctccaccccgcgaagtcaattgaacccgcccaattggcccgctgcccaggtgtatcaggaaaaccccgctccgaccacagttctcctgccacgcgacgctgaggccgaagtccagatgactaactccggagcgcaattagcgggcggatccagacacgtcaggttcagaggtcggtcctcgccctactctccaggtcctataaagaggctgattatccgaggccggggtatccagctcaacgacgaagtggtgagctccttagccggcctccgacctgacggagttttccagcttggaggtgccggccgctcctccttcactcctcgccaggcgtacctgacactccagagctcttcttcccagcctcgctccggcggcattggaaccctccagtttgtggaggagtttgtaccctccgtttacttcaacccattctcgggcgctcctggtctttacccagacgacttcatcccaaactacgacgcggtgagcgaatctgtggacggctacgactga

SEQ ID NO: 1436 - DNA, 522 bp, Adenovirus F41
  MISC_FEATURE (1)..(522): F41.ORF00021 E3 19.4 KDA
atgaagatctgtgttcttttttgtgtgctaagtttaacaagtagcctaaagacttcacctacagccgttggttctttacgtcagctgcaagattccaacaaaggtacacaccaaactctttatttttctgagtctaccacttctattgcacttaactgttcttgtcgtaaccaactcgttcagtggcgcgctaacagacaattttgcaaactattttgggacgctcttattgttcaaggaaacaacagcctttgtaacaactgtactgctactactttaactcttacacctccttttgttcccggtccatacttgtgcattggcacaggaagagggcctagctgctttaatcgctggactttacaaaaagagaacctaaccactaccaccctccttccccttactacttatactttttcccaaaaaaaaatttactttttgcccattattgcacttttggcctttgtctgtgttattaccgctaattacattttaattttcaatcttgataatttttactaa

SEQ ID NO: 1437 - DNA, 831 bp, Adenovirus F41
  MISC_FEATURE (1)..(831): F41.ORF00022 E3 31.6K
atgctgctgtttttactttgccttcttttctgctctgcctatgccgccgtgccagaaaaaactcttaacaacctcgttcgggtgtacgccttagttggtaccaatctatcccttgattctatgaaaactcctcagattgacgaacttactagtcttagctggattaaacaggaagacaatcctaacaaaaacttacaatcatttttttttattggtcaaaaactctgtgaagttaccaaagacaaaatcactgtttttaactattatccgttggaattttcctgcgctaacgtaaccttgtatttgtataatcttaaaactgacgattctggcctctataatggaaaggcccataccaaagagcttgaacataacacctatgttaggctttatgttattgacattcctccgcctaagtgtgacattacttcacgttacttaggcatacaggctactggggaagattattgtttaattgaaatcaattgcactaactccaaatacccagctgtggttaaatttaatggcaggcaaagcaacttctaccattatgttagcgaaaacggaaacaaagaacttccaaatttttatgaaacacacatcactattaatggtacccacaaaagctttcactttaattacccttttaacgacctttgtcaaacaaccagcgctctacaatataatgacaatgtccaggtagtcctcattcttctcatagtagttggcttaataataatttccgctagtttaatattgctttattgccaccgcaaaaaaatcaaggccgaagttcaacatcaaccagtgcatatttgtttagaaaaataa

SEQ ID NO: 1438 - DNA, 273 bp, Adenovirus F41
  MISC_FEATURE (1)..(273): F41.ORF00023 E3 10.1K
atggtaactcctcttctcctgcttgtctgtctgccaattatctacgcctccaccaccttcgccgcagtctcccaccttgatacggattgtcttcccgccttgctgacttatctcatcttcacctctgtttgctgcactgccatctgcagcattgccactttttttgtggccattttccaaactgcggactacctatacgttagagtggcatactatcgtcatcatccccaatataggaaccacgaggtggccgcccttctgtgcctgtcatga

SEQ ID NO: 1439 - DNA, 324 bp, Adenovirus F41
  MISC_FEATURE (1)..(324): F41.ORF00024 E3 14.5K
atgaaagttcctcttctctgtcttatcctcctttacaaagtcctggccaactgccacctccaccggcccaccgagttcctgcgctgctactcaacagaaacctcttccttttggctgtactccattatttttattttgattttctttgccacctttttgggattacaaatttacggctgccttcacctgggctggatgcatcctcccaacaacctacccagatttcctggtttcttattacagcccccgccgcccccaccagctcctgtacagcgcgctccatcagttattagctactttcatcttaactctgaagatgtctga

SEQ ID NO: 1440 - DNA, 369 bp, Adenovirus F41
  MISC_FEATURE (1)..(369): F41.ORF00025 E3 14.7K
atgtctgaccaactagaaatcgacgggcagcgcactgagcagctgatccttgctcggcgaaaactcaaacaacaaaaccaggaattgttcaaccttcaagccttacaccaatgcaaaaagggtcttttctgcctggttaaacaagctgaactttgctatgatgtaacccaacaggggcatgagctatcatacactttaaacaagcaaagacagagctttatgactatggtgggggttaagcccattaaggttactcagcaatccggcccagttgagggaagcattctttgtcagtgcaccaattctgaatgcatgtacactatggtaaaaaccctgtgtggtctcagggaacttctcccctttaattaa

SEQ ID NO: 1441 - DNA, 162 bp, Adenovirus F41
  MISC_FEATURE (1)..(162): F41.ORF00026 TRUNCATED U EXON PROTEIN
ttaccttaaatttgatatcagttgtttgtcaagtttttccagcagcaccacctgcccttcctcccaactttcgtaggggatgtgccaacgggcagcaaactttctccacgtcctaaagggtatatcggtgttcacctttttaccctgacccacgatcttcat

SEQ ID NO: 1442 - DNA, 1164 bp, Adenovirus F41
  MISC_FEATURE (1)..(1164): F41.ORF00027 SHORT FIBER PROTEIN
atgaaaagaaccagaattgaagacgacttcaaccccgtctacccctatgacaccttctcaactcccagcatcccctatgtagctccgcccttcgtttcttctgacgggttacaggaaaaacccccaggagttttagcactcaagtacactgaccccattactaccaatgctaagcatgagcttactttaaaacttggaagcaacataactttagaaaatgggttactttcggccacagttcccactgtttctcctccccttacaaacagtaacaactccctgggtttagccacatccgctcccatagctgtatcagctaactctctcacattggccaccgccgcaccactgacagtaagcaacaaccagcttagtattaacgcgggcagaggcttagttataactaacaatgccgtagcggttaatcctaccggagcgttaggcttcaataacacaggagctttacaattaaatgctgcaggaggaatgagagtggacggtgccaacttaattcttcatgtagcatatccctttgaagcagtcaaccaactaacactgcgattagaaaacgggttagaagtaaccagcggaggaaagcttaacgttaagttgggatcaggcctccaatttgacagtaacggacgcattgctattagtaatagcaaccgaactcgaagtgtaccatccctcactaccatttggtctatctcgcctacgcctaactgctccatttatgaaacccaagatgcaaacctatttctttgtctaactaaaaacggagctcacgtattaggtactataacaatcaaaggtcttaaaggagcactgcgggaaatgcacgataacgctctatctctaaaacttccctttgacaatcagggaaatttacttaactgtgccttggaatcatccacctggcgttaccaggaaaccgacgcagtggcctctaatgccttaacatttatgcccaacagtacagtgtatccacgaaacaaaaccgctgacccaggcaacatgctcatccaaatctcgcctaacatcaccttcagtgtcgtctacaacgagataaacagtgggtatgcttttacttttaaatggtcagccgaaccgggaaaaccttttcacccacccaccgctgtattttgctacataactgaacaataa

SEQ ID NO: 1443 - DNA, 1689 bp, Adenovirus F41
  MISC_FEATURE (1)..(1689): F41.ORF00028 LONG FIBER PROTEIN
atgaaacgagccagacttgaagatgacttcaaccccgtctacccttacgaacactacaatccccttgacatcccatttattacacccccgtttgcctcctccaacggcttgcaagaaaaacctccgggagtcctcagcctgaaatacactgatccacttacaaccaaaaacggggctttaaccttaaaactgggcacgggactaaacattgatgaaaatggagatctttcttcagatgctagcgtggaagttagcgcccctattactaaaaccaacaaaatcgtaggtttaaattacactaaacctctcgccctgcgaagtaacgcgctcactctttcttacaacgctcccttaaacgtagtaaataacaatttagctctaaatatctcacaacctgtcactgttaatgcaaacaacgaactttctctcttaatagacgccccacttaatgctgacacgggcactcttcgccttcaaagtgctgcacctcttggactagtggacaaaacactaaaagttttgttttctagccccctctatctagataacaactttcttacactagccattgaacgcccgctagctctatccagtaacagagcagtgacccttaagtattcaccacctttaaaaatagaaaacgaaaacttaaccctaagcacaggcggaccttttactgtaagcgggggaaatctaaacttaacaacatcggcacccctctccgtgcaaaacaactctctctccttattcattacttctcctttaaaagttattaattctatgttagctgttggggttaacccgccttttaccatcactgactctggattagctatggacttaggagacggtcttgcactaggtggctctaagttaataatcaatcttggtccaggtttacaaatgtctaatggagccattactttagcactagatgcagcgctgcctttgcaatatagagacaaccaacttcaactcagaattggctcaacgtctggcttaattatgagcggagtaacacaaacattaaacgtcaatgccaataccggcaaaggtcttgctgttgaaaacaactcactagttgttaagcttgggaacggtcttcgctttgatagctggggaagcataactgtttcgcctactaccactacccctaccaccctatggaccaccgcagacccgtctcctaacgccactttttatgaatcactagacgccaaagtgtggctagttttagtaaaatgcaacggcatggttaacgggaccatatccattaaagctcagaaaggcattttacttagacctacagctagttttatttcctttgtcatgtatttctacagcgacggaacatggagaaaaaactatcccgtgtttgacaacgaagggatactagcaaacagtgccacgtggggttatcgacaaggacagtctgccaacactaacgtttctaatgctgtagaatttatgcctagctctaaaagatatcccaatcaaaaaggttctgaagttcagaacatggctcttacctacacttttttgcaaggtgatcctaacatggccatatcctttcagagtatttataatcatgcattagaaggctactcattaaaatttacctggcgcgttcgaaataatgaacgttttgacatcccctgctgctcattttcttatgtaacagaacaataa

SEQ ID NO: 1444 - DNA, 870 bp, Adenovirus F41
  MISC_FEATURE (1)..(870): F41.ORF00029 PUTATIVE E4 PROTEIN 6
tcaagctctccacgggttttcgcctctgttgtagtctgccaacgtaaacgggcagtaccgttccattaagccccgcagtaatccctgtctccggggttccaccaagcttttcagaagtgacctaacggtgaagcttcccaaaactttcaccgccttggcgagcaaccgccgcgtccgacgggcacagcatcgcacagaaagctcatccaagtttttacaataggtacagcccaacaccaccatattattcatgattccataactaaaaaaactccacccaaatgacatgcgctccaacactatagccgcatgcccatcatacagcaagcgaatatacataatatgtctacctctgacaaacacgctccccataaataacacttccttgggcatgccacagtttacaatttctcgataccaagggaatctcaagttatacagtgaaccataaatcatcattttaaaccagtttgctaacactacaccgcccgccttacattgaagagacccaggtttattacagtgacagtgtatagtccagcgctcaaaacctcttacaatttgattaaaatcaacattaagagtggcacaacaaacacaaacacgcatgtaaattctacacacatgcttttcccatttagacagtatcatgtcccaccacattggccattcctgcaatactataaagggagcacaagatggaatagacctcacctcgctcacataatgcatattcaaatgttcacactctaaaagtccaggagtcctttccattgtggcaatgggcacaaaatcctcagagggaggtggaaggcggtgggtttggtacgaactcagtttgtagcgaaaccatctgtcgcgttgcatcat

SEQ ID NO: 1445 - DNA, 366 bp, Adenovirus F41
  MISC_FEATURE (1)..(366): F41.ORF00030 PUTATIVE E4 PROTEIN 4
tcagagggaggtggaaggcggtgggtttggtacgaactcagtttgtagcgaaaccatctgtcgcgttgcatcataaattaaaagctcgcgcacagcttcgtacttctgttttaaaaagcgaacacgctgccaacaaatgttcgcaaaccgacggtttcgttggcgcgctctttcagttttcagggcagtgttcagccactcctgcagtccacttaacagctcctcagcccgtggagatatgctgacatcataccttattatgtccccataaacgttcaaacagcaggttaaagccaactccaaccaagcaatacaaaggccttgatcccgactcactggaggtggagggagagacggaagaggcat

SEQ ID NO: 1446 - DNA, 351 bp, Adenovirus F41
  MISC_FEATURE (1)..(351): F41.ORF00031 PUTATIVE E4 PROTEIN 3
ttattccagacggttgtaaagccagccaaagtgcaagtcacgaagatcacacctctccccaccgctgcgttggtaaaaaattacagccaagtcaaaaaagatgcgattttccaaattaccaatcaccgcttccactaaggctggcacacgcacttcaagaaacacaaacatagcaaaagcattttcctcaaaatcttcaaacattaagctgcaatcttgaataactcccaaataattttctgcttgccacccgcgcaacacatccattaaaatttcttgtagactggcgccatgcaattcaaaaagcttgttgagagcgccctctactgtcatacgcaggcacaccttcat

SEQ ID NO: 1447 - DNA, 393 bp, Adenovirus F41
  MISC_FEATURE (1)..(393): F41.ORF00032 PUTATIVE E4 PROTEIN 2
tcatggttgaaaaagatcaggttcccgtgtcacctgcagttcatttaaaagatcaacatcaggctcaaaaccccgatcccgaatctccgtgcgtagcattaattgtacaaagtcatccaaatcattgcatataagctctgtcagttcgctatcaggaagcagctcaggcgatgctacacaacaaatcatttctagcgtgggagctaaagacgttaaagtaaagccacaataagcagcttgaaaaactggagtaacacaatgtaaaatgtgcagcaaaaactccgacatgtttgtctttaaaaaatctaccacagaaatgtccatattatttaaataaaacatcaggggctgaggaaccaccaccgaaataaaaataggtcgtaacaaaaacat

SEQ ID NO: 1448 - DNA, 85 bp, Artificial Sequence
  Oligo 1 partial sequence used in cloning
gctttatatatcttgtggaaaggacgaaacaccggagacccgactagtagggtctctgttttagagctagaaatagcaagttaaa

SEQ ID NO: 1449 - DNA, 85 bp, Artificial Sequence
  Oligo 1 partial sequence used in cloning
tttaacttgctatttctagctctaaaacagagaccctactagtcgggtctccggtgtttcgtcctttccacaagatatataaagc

SEQ ID NO: 1450 - DNA, 60 bp, Artificial Sequence
  Oligos 2/3 partial sequence used in cloning
cttgtggaaaggacgaaacaccgggtcttcgagaagacctgttttagagctagaaatagc

SEQ ID NO: 1451 - DNA, 60 bp, Artificial Sequence
  Oligos 2/3 partial sequence used in cloning
gctatttctagctctaaaacaggtcttctcgaagacccggtgtttcgtcctttccacaag

SEQ ID NO: 1452 - DNA, 22 bp, Artificial Sequence
  hexon-fwd primer
atggccaccccatcgatgatgc

SEQ ID NO: 1453 - DNA, 22 bp, Artificial Sequence
  hexon-rev primer
ttatgtggtggcgttgccggcc

SEQ ID NO: 1454 - DNA, 33 bp, Artificial Sequence
  Adaptor-Oligo 1
acactctttccctacacgacgctcttccgatct

SEQ ID NO: 1455 - DNA, 33 bp, Artificial Sequence
  Adaptor-Oligo 2
gatcggaagagcacacgtctgaactccagtcac

The invention claimed is:

1. A method for cloning an adenoviral sequence, wherein the adenoviral sequence is a full length adenoviral genome sequence, comprising:
   a) providing a first linear nucleic acid molecule which comprises the full length adenoviral genome sequence;
   b) providing a linearized medium copy plasmid which shares at least two regions of sequence homology with the first linear nucleic acid molecule; and
   c) bringing the first linear nucleic acid molecule and the linearized medium copy plasmid into contact in the presence of a 5' to 3' exonuclease and an annealing protein such that the first linear nucleic acid molecule and the linearized medium copy plasmid recombine to form a circular plasmid containing the full length adenoviral genome sequence;
   wherein the 5' to 3' exonuclease is full length RecE of SEQ ID NO:1412, or a protein with at least 95% sequence identity to SEQ ID NO:1412, and the annealing protein is RecT,
   and wherein a first region of the at least two regions of sequence homology is a region of sequence homology with the 5' ITR of the adenoviral sequence in the first linear nucleic acid molecule, and a second region of the at least two regions of sequence homology is a region of sequence homology with the 3' ITR of the adenoviral sequence in the first linear nucleic acid molecule, and wherein each of the first region and the second region is 40-80 nucleotides in length.

2. The method of claim 1, wherein the first linear nucleic acid molecule is present in a mixture.

3. The method of claim 1, wherein the linearized medium copy plasmid is a p15A origin-based vector.

4. The method of claim 1, further comprising the generation of an adenoviral vector from the circular medium-copy plasmid comprising the full length adenoviral genome sequence, comprising:
   a) providing a second linear nucleic acid molecule which shares at least two regions of sequence homology with the circular medium-copy plasmid comprising the full length adenoviral genome sequence, wherein the second linear nucleic acid molecule comprises one or more transgenes of interest situated between two regions of sequence homology; and
   b) bringing the circular medium-copy plasmid comprising the full length adenoviral genome sequence and the second linear nucleic acid molecule into contact in the presence of a 5' to 3' exonuclease and an annealing protein such that sequences between the regions of homology in the second linear nucleic acid molecule are introduced into the circular medium-copy plasmid;
   wherein:
   i) the 5' to 3' exonuclease is RecE and the annealing protein is RecT; or ii) the 5' to 3' exonuclease is Red alpha and the annealing protein is Red beta.

5. The method of claim 4, further comprising a step of releasing the adenoviral vector in linear form from the circular medium copy plasmid.

6. The method of claim 4, wherein the one or more transgenes include one or more reporter genes.

7. The method of claim 6, wherein the one or more reporter genes include one or more genes encoding a fluorescent protein and/or a luciferase gene.

8. The method of claim 1, further comprising a step of creating a library comprising two or more medium copy plasmids each comprising a full length adenoviral genome sequence.

9. The method of claim 8, wherein the cloned adenoviruses in the library are tagged with one or more reporter genes.

10. The method of claim 9, wherein the one or more reporter genes include one or more genes encoding a fluorescent protein and/or a luciferase gene.

* * * * *